(12) United States Patent
Porreca et al.

(10) Patent No.: US 12,129,514 B2
(45) Date of Patent: *Oct. 29, 2024

(54) METHODS AND COMPOSITIONS FOR EVALUATING GENETIC MARKERS

(71) Applicant: Molecular Loop Biosolutions, LLC, Cambridge, MA (US)

(72) Inventors: Gregory J. Porreca, Cambridge, MA (US); Mark Umbarger, Brookline, MA (US)

(73) Assignee: Molecular Loop Biosolutions, LLC, Cambridge, MA (US)

( * ) Notice: Subject to any disclaimer, the term of this patent is extended or adjusted under 35 U.S.C. 154(b) by 0 days.

This patent is subject to a terminal disclaimer.

(21) Appl. No.: 13/934,093

(22) Filed: Jul. 2, 2013

(65) Prior Publication Data

US 2013/0337447 A1    Dec. 19, 2013

Related U.S. Application Data

(63) Continuation-in-part of application No. 13/266,862, filed as application No. PCT/US2010/001293 on Apr. 30, 2010.

(60) Provisional application No. 61/789,164, filed on Mar. 15, 2013, provisional application No. 61/182,089, filed on May 28, 2009, provisional application No. 61/179,358, filed on May 18, 2009, provisional application No. 61/178,923, filed on May 15, 2009, provisional application No. 61/174,470, filed on Apr. 30, 2009.

(51) Int. Cl.
| | | |
|---|---|---|
| *C12Q 1/6813* | (2018.01) | |
| *C12Q 1/6827* | (2018.01) | |
| *C12Q 1/6886* | (2018.01) | |

(52) U.S. Cl.
CPC ......... *C12Q 1/6813* (2013.01); *C12Q 1/6827* (2013.01); *C12Q 1/6886* (2013.01); *C12Q 2537/159* (2013.01); *C12Q 2600/156* (2013.01)

(58) Field of Classification Search
None
See application file for complete search history.

(56) References Cited

U.S. PATENT DOCUMENTS

| | | |
|---|---|---|
| 4,683,195 A | 7/1987 | Mullis et al. |
| 4,683,202 A | 7/1987 | Mullis |
| 4,988,617 A | 1/1991 | Landegren et al. |
| 5,060,980 A | 10/1991 | Johnson et al. |
| 5,210,015 A | 5/1993 | Gelfand et al. |
| 5,234,809 A | 8/1993 | Boom et al. |
| 5,242,794 A | 9/1993 | Whiteley et al. |
| 5,348,853 A | 9/1994 | Wang et al. |
| 5,434,049 A | 7/1995 | Okano et al. |
| 5,459,307 A | 10/1995 | Klotz, Jr. |
| 5,486,686 A | 1/1996 | Zdybel, Jr. et al. |
| 5,491,224 A | 2/1996 | Bittner et al. |
| 5,494,810 A | 2/1996 | Barany et al. |
| 5,567,583 A | 10/1996 | Wang et al. |
| 5,583,024 A | 12/1996 | McElroy et al. |
| 5,604,097 A | 2/1997 | Brenner |
| 5,636,400 A | 6/1997 | Young |
| 5,674,713 A | 10/1997 | McElroy et al. |
| 5,695,934 A | 12/1997 | Brenner |
| 5,700,673 A | 12/1997 | McElroy et al. |
| 5,701,256 A | 12/1997 | Marr et al. |
| 5,830,064 A | 11/1998 | Bradish et al. |
| 5,846,719 A | 12/1998 | Brenner et al. |
| 5,863,722 A | 1/1999 | Brenner |
| 5,866,337 A | 2/1999 | Schon |
| 5,869,252 A | 2/1999 | Bouma et al. |
| 5,869,717 A | 2/1999 | Frame et al. |
| 5,871,921 A | 2/1999 | Landegren et al. |
| 5,888,788 A | 3/1999 | De Miniac |
| 5,942,391 A | 8/1999 | Zhang et al. |
| 5,971,921 A | 10/1999 | Timbel |
| 5,993,611 A | 11/1999 | Moroney, III et al. |
| 5,994,056 A | 11/1999 | Higuchi |
| 6,020,127 A | 2/2000 | MacKenzie et al. |
| 6,033,854 A | 3/2000 | Kurnit et al. |
| 6,033,872 A | 3/2000 | Bergsma et al. |
| 6,100,099 A | 8/2000 | Gordon et al. |
| 6,138,077 A | 10/2000 | Brenner |
| 6,150,516 A | 11/2000 | Brenner et al. |
| 6,171,785 B1 | 1/2001 | Higuchi |
| 6,172,214 B1 | 1/2001 | Brenner |
| 6,172,218 B1 | 1/2001 | Brenner |

(Continued)

FOREIGN PATENT DOCUMENTS

| | | |
|---|---|---|
| EP | 1321477 A1 | 6/2003 |
| EP | 1564306 A2 | 8/2005 |

(Continued)

OTHER PUBLICATIONS

May et al (Science (1988) vol. 241, p. 1441).*
Benner et al (Trends in Genetics (2001) vol. 17, pp. 414-418).*
International Human Genome Sequencing Consortium ( Nature (2004) vol. 431, pp. 931-945).*
Ostrer et al (Nature Reviews (2001) vol. 2, pp. 891-898).*
Fares et al (Prenatal Diagnosis (2008) vol. 28, pp. 236-241).*
Zubin et al ( Current opinion in Neurology (2009) vol. 22, pp. 19-27).*
Flaschker et al ( J, Inherit Metab Mis (2007) vol. 30, pp. 903-909).*
Diep et al (Nature methods (2012) vol. 9, pp. 270-272 and supplemental information).*

(Continued)

*Primary Examiner* — Narayan K Bhat
(74) *Attorney, Agent, or Firm* — Withers Bergman LLP; Thomas C. Meyers

(57) ABSTRACT

Aspects of the invention relates to methods and compositions that are useful to reduce bias and increase the reproducibility of multiplex analysis of genetic loci. In some configurations, predetermined preparative steps and/or nucleic acid sequence analysis techniques are used in multiplex analyses for a plurality of genetic loci in a plurality of samples.

14 Claims, 42 Drawing Sheets

Specification includes a Sequence Listing.

(56) References Cited

U.S. PATENT DOCUMENTS

| | | |
|---|---|---|
| 6,197,508 B1 | 3/2001 | Stanley |
| 6,197,574 B1 | 3/2001 | Miyamoto et al. |
| 6,210,891 B1 | 4/2001 | Nyren et al. |
| 6,223,128 B1 * | 4/2001 | Allex .................. G16B 30/00 702/20 |
| 6,235,472 B1 | 5/2001 | Landegren et al. |
| 6,235,475 B1 | 5/2001 | Brenner et al. |
| 6,235,501 B1 | 5/2001 | Gautsch et al. |
| 6,235,502 B1 | 5/2001 | Weissman et al. |
| 6,258,568 B1 | 7/2001 | Nyren |
| 6,274,320 B1 | 8/2001 | Rothberg et al. |
| 6,306,597 B1 | 10/2001 | Macevicz |
| 6,352,828 B1 | 3/2002 | Brenner |
| 6,360,235 B1 | 3/2002 | Tilt et al. |
| 6,361,940 B1 | 3/2002 | Van Ness et al. |
| 6,403,320 B1 | 6/2002 | Read et al. |
| 6,462,254 B1 | 10/2002 | Vernachio et al. |
| 6,489,105 B1 | 12/2002 | Matlashewski et al. |
| 6,558,928 B1 | 5/2003 | Landegren |
| 6,569,920 B1 | 5/2003 | Wen et al. |
| 6,582,938 B1 | 6/2003 | Su et al. |
| 6,585,938 B1 | 7/2003 | Machida et al. |
| 6,613,516 B1 | 9/2003 | Christians et al. |
| 6,714,874 B1 | 3/2004 | Myers et al. |
| 6,716,580 B2 | 4/2004 | Gold et al. |
| 6,719,449 B1 | 4/2004 | Laugharn, Jr. et al. |
| 6,818,395 B1 | 11/2004 | Quake et al. |
| 6,828,100 B1 | 12/2004 | Ronaghi |
| 6,833,246 B2 | 12/2004 | Balasubramanian |
| 6,858,412 B2 | 2/2005 | Willis et al. |
| 6,911,345 B2 | 6/2005 | Quake et al. |
| 6,913,879 B1 | 7/2005 | Schena |
| 6,927,024 B2 | 8/2005 | Dodge et al. |
| 6,941,317 B1 | 9/2005 | Chamberlin et al. |
| 6,948,843 B2 | 9/2005 | Laugharn, Jr. et al. |
| 7,034,143 B1 | 4/2006 | Preparata et al. |
| 7,041,481 B2 | 5/2006 | Anderson et al. |
| 7,049,077 B2 | 5/2006 | Yang |
| 7,057,026 B2 | 6/2006 | Barnes et al. |
| 7,071,324 B2 | 7/2006 | Preparata et al. |
| 7,074,564 B2 | 7/2006 | Landegren |
| 7,074,586 B1 | 7/2006 | Cheronis et al. |
| 7,115,400 B1 | 10/2006 | Adessi et al. |
| 7,169,560 B2 | 1/2007 | Lapidus et al. |
| 7,211,390 B2 | 5/2007 | Rothberg et al. |
| 7,232,656 B2 | 6/2007 | Balasubramanian et al. |
| 7,244,559 B2 | 7/2007 | Rothberg et al. |
| RE39,793 E | 8/2007 | Brenner |
| 7,264,929 B2 | 9/2007 | Rothberg et al. |
| 7,282,337 B1 | 10/2007 | Harris |
| 7,297,518 B2 | 11/2007 | Quake et al. |
| 7,320,860 B2 | 1/2008 | Landegren et al. |
| 7,323,305 B2 | 1/2008 | Leamon et al. |
| 7,335,762 B2 | 2/2008 | Rothberg et al. |
| 7,351,528 B2 | 4/2008 | Landegren |
| 7,393,665 B2 | 7/2008 | Brenner |
| 7,510,829 B2 | 3/2009 | Faham et al. |
| 7,523,117 B2 | 4/2009 | Zhang et al. |
| 7,537,889 B2 | 5/2009 | Sinha et al. |
| 7,537,897 B2 | 5/2009 | Brenner et al. |
| 7,544,473 B2 | 6/2009 | Brenner |
| 7,582,431 B2 | 9/2009 | Drmanac et al. |
| 7,598,035 B2 | 10/2009 | Macevicz |
| 7,629,151 B2 | 12/2009 | Gold et al. |
| 7,642,056 B2 | 1/2010 | Ahn et al. |
| 7,666,593 B2 | 2/2010 | Lapidus |
| 7,700,323 B2 | 4/2010 | Willis et al. |
| 7,774,962 B1 | 8/2010 | Ladd |
| 7,776,616 B2 | 8/2010 | Heath et al. |
| RE41,780 E | 9/2010 | Anderson et al. |
| 7,790,388 B2 | 9/2010 | Landegren et al. |
| 7,809,509 B2 | 10/2010 | Milosavljevic |
| 7,835,871 B2 | 11/2010 | Kain et al. |
| 7,862,999 B2 | 1/2011 | Zheng et al. |
| 7,865,534 B2 | 1/2011 | Chandra et al. |
| 7,883,849 B1 | 2/2011 | Dahl |
| 7,957,913 B2 | 6/2011 | Chinitz et al. |
| 7,960,120 B2 | 6/2011 | Rigatti et al. |
| 7,985,716 B2 | 7/2011 | Yershov et al. |
| 7,993,880 B2 | 8/2011 | Willis et al. |
| 8,024,128 B2 | 9/2011 | Rabinowitz et al. |
| 8,114,027 B2 | 2/2012 | Triva |
| 8,165,821 B2 | 4/2012 | Zhang |
| 8,209,130 B1 | 6/2012 | Kennedy et al. |
| 8,283,116 B1 | 10/2012 | Bhattacharyya et al. |
| 8,462,161 B1 | 6/2013 | Barber |
| 8,463,895 B2 | 6/2013 | Arora et al. |
| 8,474,228 B2 | 7/2013 | Adair et al. |
| 8,496,166 B2 | 7/2013 | Burns et al. |
| 8,529,744 B2 | 9/2013 | Marziali et al. |
| 8,738,300 B2 | 5/2014 | Porreca et al. |
| 8,778,609 B1 | 7/2014 | Umbarger |
| 8,812,422 B2 | 8/2014 | Nizzari et al. |
| 8,847,799 B1 | 9/2014 | Kennedy et al. |
| 8,976,049 B2 | 3/2015 | Kennedy et al. |
| 9,074,244 B2 | 7/2015 | Sparks et al. |
| 9,115,387 B2 | 8/2015 | Umbarger |
| 9,228,233 B2 | 1/2016 | Kennedy et al. |
| 9,292,527 B2 | 3/2016 | Kennedy et al. |
| 9,535,920 B2 | 1/2017 | Kennedy et al. |
| 9,567,639 B2 | 2/2017 | Oliphant et al. |
| 9,677,124 B2 | 6/2017 | Umbarger |
| 10,066,259 B2 | 9/2018 | Gore et al. |
| 10,202,637 B2 | 2/2019 | Umbarger |
| 10,227,635 B2 | 3/2019 | Umbarger et al. |
| 10,604,799 B2 | 3/2020 | Porreca et al. |
| 10,683,533 B2 | 6/2020 | Umbarger et al. |
| 2001/0007742 A1 | 7/2001 | Landergren |
| 2001/0046673 A1 | 11/2001 | French et al. |
| 2002/0001800 A1 | 1/2002 | Lapidus |
| 2002/0040216 A1 | 4/2002 | Dumont et al. |
| 2002/0042052 A1 | 4/2002 | Nilsen et al. |
| 2002/0091666 A1 | 7/2002 | Rice et al. |
| 2002/0164629 A1 | 11/2002 | Quake et al. |
| 2002/0172954 A1 | 11/2002 | Mao et al. |
| 2002/0182609 A1 | 12/2002 | Arcot |
| 2002/0187496 A1 | 12/2002 | Andersson et al. |
| 2002/0190663 A1 | 12/2002 | Rasmussen |
| 2003/0166057 A1 | 9/2003 | Hildebrand et al. |
| 2003/0175709 A1 | 9/2003 | Murphy et al. |
| 2003/0177105 A1 | 9/2003 | Xiao et al. |
| 2003/0203370 A1 | 10/2003 | Yakhini et al. |
| 2003/0208454 A1 | 11/2003 | Rienhoff et al. |
| 2003/0224384 A1 | 12/2003 | Sayood et al. |
| 2004/0029264 A1 | 2/2004 | Robbins |
| 2004/0053275 A1 | 3/2004 | Shafer |
| 2004/0106112 A1 | 6/2004 | Nilsson et al. |
| 2004/0121373 A1 | 6/2004 | Friedlander et al. |
| 2004/0142325 A1 | 7/2004 | Mintz et al. |
| 2004/0152108 A1 | 8/2004 | Keith et al. |
| 2004/0161773 A1 | 8/2004 | Rogan et al. |
| 2004/0170965 A1 | 9/2004 | Scholl et al. |
| 2004/0171051 A1 | 9/2004 | Holloway |
| 2004/0175719 A1 | 9/2004 | Christians |
| 2004/0197813 A1 | 10/2004 | Hoffman et al. |
| 2004/0209299 A1 | 10/2004 | Pinter et al. |
| 2005/0003369 A1 | 1/2005 | Christians et al. |
| 2005/0026204 A1 | 2/2005 | Landegren |
| 2005/0032095 A1 | 2/2005 | Wigler et al. |
| 2005/0048505 A1 | 3/2005 | Fredrick et al. |
| 2005/0059048 A1 | 3/2005 | Gunderson et al. |
| 2005/0100900 A1 | 5/2005 | Kawashima et al. |
| 2005/0112590 A1 | 5/2005 | Boom et al. |
| 2005/0186589 A1 | 8/2005 | Kowalik et al. |
| 2005/0214811 A1 | 9/2005 | Margulies et al. |
| 2005/0244879 A1 | 11/2005 | Schumm et al. |
| 2005/0250147 A1 | 11/2005 | Macevicz |
| 2005/0272065 A1 | 12/2005 | Lakey et al. |
| 2006/0008824 A1 | 1/2006 | Ronaghi et al. |
| 2006/0019304 A1 | 1/2006 | Hardenbol et al. |
| 2006/0024681 A1 | 2/2006 | Smith et al. |
| 2006/0030536 A1 | 2/2006 | Yu et al. |
| 2006/0078894 A1 | 4/2006 | Winkler et al. |
| 2006/0149047 A1 | 7/2006 | Nanduri et al. |

(56) References Cited

U.S. PATENT DOCUMENTS

| | | |
|---|---|---|
| 2006/0177837 A1 | 8/2006 | Borozan et al. |
| 2006/0183132 A1 | 8/2006 | Fu et al. |
| 2006/0192047 A1 | 8/2006 | Goossen |
| 2006/0195269 A1 | 8/2006 | Yeatman et al. |
| 2006/0246500 A1 | 11/2006 | Browne |
| 2006/0263789 A1 | 11/2006 | Kincaid |
| 2006/0281098 A1 | 12/2006 | Miao et al. |
| 2006/0286577 A1 | 12/2006 | Jia |
| 2006/0292585 A1 | 12/2006 | Nautiyal et al. |
| 2006/0292611 A1 | 12/2006 | Berka et al. |
| 2007/0009925 A1* | 1/2007 | Fang .................. C12Q 1/6806 435/6.12 |
| 2007/0020640 A1 | 1/2007 | McCloskey et al. |
| 2007/0042369 A1 | 2/2007 | Reese et al. |
| 2007/0092883 A1 | 4/2007 | Schouten et al. |
| 2007/0114362 A1 | 5/2007 | Feng et al. |
| 2007/0128624 A1 | 6/2007 | Gormley et al. |
| 2007/0161013 A1 | 7/2007 | Hantash |
| 2007/0162983 A1 | 7/2007 | Hesterkamp et al. |
| 2007/0166705 A1 | 7/2007 | Milton et al. |
| 2007/0212704 A1* | 9/2007 | Dong .................. G01N 21/6486 435/6.12 |
| 2007/0225487 A1 | 9/2007 | Nilsson et al. |
| 2007/0238122 A1 | 10/2007 | Allbritton et al. |
| 2007/0244675 A1 | 10/2007 | Shai et al. |
| 2007/0264653 A1 | 11/2007 | Berlin et al. |
| 2008/0003142 A1 | 1/2008 | Link et al. |
| 2008/0014589 A1 | 1/2008 | Link et al. |
| 2008/0076118 A1 | 3/2008 | Tooke et al. |
| 2008/0081330 A1 | 4/2008 | Kahvejian |
| 2008/0085836 A1 | 4/2008 | Kearns et al. |
| 2008/0090239 A1 | 4/2008 | Shoemaker et al. |
| 2008/0125324 A1 | 5/2008 | Petersdorf et al. |
| 2008/0176209 A1 | 7/2008 | Muller et al. |
| 2008/0269068 A1 | 10/2008 | Church et al. |
| 2008/0280955 A1 | 11/2008 | McCamish |
| 2008/0293589 A1 | 11/2008 | Shapero |
| 2009/0009904 A1 | 1/2009 | Yasuna et al. |
| 2009/0019156 A1 | 1/2009 | Mo et al. |
| 2009/0026082 A1 | 1/2009 | Rothberg et al. |
| 2009/0029385 A1 | 1/2009 | Christians et al. |
| 2009/0035777 A1 | 2/2009 | Kokoris et al. |
| 2009/0042206 A1 | 2/2009 | Schneider et al. |
| 2009/0098551 A1 | 4/2009 | Landers et al. |
| 2009/0099041 A1 | 4/2009 | Church et al. |
| 2009/0105081 A1 | 4/2009 | Rodesch et al. |
| 2009/0119313 A1 | 5/2009 | Pearce |
| 2009/0127589 A1 | 5/2009 | Rothberg et al. |
| 2009/0129647 A1 | 5/2009 | Dimitrova et al. |
| 2009/0156412 A1 | 6/2009 | Boyce, IV et al. |
| 2009/0163366 A1 | 6/2009 | Nickerson et al. |
| 2009/0181389 A1 | 7/2009 | Li et al. |
| 2009/0191565 A1 | 7/2009 | Lapidus et al. |
| 2009/0192047 A1 | 7/2009 | Parr et al. |
| 2009/0202984 A1 | 8/2009 | Cantor |
| 2009/0203014 A1 | 8/2009 | Wu et al. |
| 2009/0220955 A1 | 9/2009 | Verrant |
| 2009/0226975 A1 | 9/2009 | Sabot et al. |
| 2009/0233814 A1 | 9/2009 | Bashkirov et al. |
| 2009/0298064 A1 | 12/2009 | Batzoglou et al. |
| 2009/0301382 A1 | 12/2009 | Patel |
| 2009/0318310 A1 | 12/2009 | Liu et al. |
| 2010/0035243 A1 | 2/2010 | Muller et al. |
| 2010/0035252 A1 | 2/2010 | Rothberg et al. |
| 2010/0063742 A1 | 3/2010 | Hart et al. |
| 2010/0069263 A1 | 3/2010 | Shendure et al. |
| 2010/0076185 A1 | 3/2010 | Adey et al. |
| 2010/0086914 A1 | 4/2010 | Bentley et al. |
| 2010/0086926 A1 | 4/2010 | Craig et al. |
| 2010/0105107 A1 | 4/2010 | Hildebrand et al. |
| 2010/0137143 A1 | 6/2010 | Rothberg et al. |
| 2010/0137163 A1 | 6/2010 | Link et al. |
| 2010/0143908 A1 | 6/2010 | Gillevet |
| 2010/0159440 A1 | 6/2010 | Messier et al. |
| 2010/0188073 A1 | 7/2010 | Rothberg et al. |
| 2010/0196911 A1 | 8/2010 | Hoffman et al. |
| 2010/0197507 A1 | 8/2010 | Rothberg et al. |
| 2010/0216151 A1 | 8/2010 | Lapidus et al. |
| 2010/0216153 A1 | 8/2010 | Lapidus et al. |
| 2010/0227329 A1 | 9/2010 | Cuppens |
| 2010/0248984 A1 | 9/2010 | Shaffer et al. |
| 2010/0282617 A1 | 11/2010 | Rothberg et al. |
| 2010/0285578 A1 | 11/2010 | Selden et al. |
| 2010/0297626 A1 | 11/2010 | McKernan et al. |
| 2010/0300559 A1 | 12/2010 | Schultz et al. |
| 2010/0300895 A1 | 12/2010 | Nobile et al. |
| 2010/0301042 A1 | 12/2010 | Kahlert |
| 2010/0301398 A1 | 12/2010 | Rothberg et al. |
| 2010/0304982 A1 | 12/2010 | Hinz et al. |
| 2010/0311061 A1 | 12/2010 | Korlach et al. |
| 2010/0330619 A1 | 12/2010 | Willis et al. |
| 2011/0004413 A1 | 1/2011 | Carnevali et al. |
| 2011/0009278 A1 | 1/2011 | Kain et al. |
| 2011/0015863 A1 | 1/2011 | Pevzner et al. |
| 2011/0021366 A1 | 1/2011 | Chinitz et al. |
| 2011/0034342 A1 | 2/2011 | Fox |
| 2011/0092375 A1 | 4/2011 | Zamore et al. |
| 2011/0098193 A1 | 4/2011 | Kingsmore et al. |
| 2011/0117544 A1 | 5/2011 | Lexow |
| 2011/0159499 A1 | 6/2011 | Hindson et al. |
| 2011/0166029 A1 | 7/2011 | Margulies et al. |
| 2011/0224105 A1 | 9/2011 | Kurn et al. |
| 2011/0230365 A1 | 9/2011 | Rohlfs et al. |
| 2011/0257889 A1 | 10/2011 | Klammer et al. |
| 2011/0288780 A1 | 11/2011 | Rabinowitz et al. |
| 2011/0301042 A1 | 12/2011 | Steinmann et al. |
| 2012/0015050 A1 | 1/2012 | Abkevich et al. |
| 2012/0021930 A1 | 1/2012 | Schoen et al. |
| 2012/0046877 A1 | 2/2012 | Hyland et al. |
| 2012/0059594 A1 | 3/2012 | Hatchwell et al. |
| 2012/0074925 A1 | 3/2012 | Oliver |
| 2012/0079980 A1 | 4/2012 | Taylor et al. |
| 2012/0115736 A1 | 5/2012 | Bjornson et al. |
| 2012/0164630 A1 | 6/2012 | Porreca et al. |
| 2012/0165202 A1 | 6/2012 | Porreca et al. |
| 2012/0179384 A1 | 7/2012 | Kuramitsu et al. |
| 2012/0214678 A1 | 8/2012 | Rava et al. |
| 2012/0216151 A1 | 8/2012 | Sarkar et al. |
| 2012/0236861 A1 | 9/2012 | Ganeshalingam et al. |
| 2012/0245041 A1 | 9/2012 | Brenner et al. |
| 2012/0252020 A1 | 10/2012 | Shuber |
| 2012/0252684 A1 | 10/2012 | Selifonov et al. |
| 2012/0258461 A1 | 10/2012 | Weisbart |
| 2012/0270212 A1 | 10/2012 | Rabinowitz et al. |
| 2012/0270739 A1 | 10/2012 | Rava et al. |
| 2013/0129755 A1 | 5/2013 | Song |
| 2013/0130921 A1 | 5/2013 | Gao et al. |
| 2013/0178378 A1 | 7/2013 | Hatch et al. |
| 2013/0183672 A1 | 7/2013 | de Laat et al. |
| 2013/0222388 A1 | 8/2013 | McDonald |
| 2013/0268206 A1 | 10/2013 | Porreca et al. |
| 2013/0268474 A1 | 10/2013 | Nizzari et al. |
| 2013/0274146 A1 | 10/2013 | Umbarger et al. |
| 2013/0275103 A1 | 10/2013 | Struble et al. |
| 2013/0288242 A1 | 10/2013 | Stoughton et al. |
| 2013/0323730 A1 | 12/2013 | Curry et al. |
| 2013/0332081 A1 | 12/2013 | Reese et al. |
| 2013/0337447 A1 | 12/2013 | Porreca et al. |
| 2013/0344096 A1 | 12/2013 | Chiang et al. |
| 2014/0129201 A1 | 5/2014 | Kennedy et al. |
| 2014/0136120 A1 | 5/2014 | Colwell et al. |
| 2014/0206552 A1 | 7/2014 | Rabinowitz et al. |
| 2014/0222349 A1 | 8/2014 | Higgins et al. |
| 2014/0228226 A1 | 8/2014 | Yin et al. |
| 2014/0255931 A1 | 9/2014 | Porreca et al. |
| 2014/0274741 A1 | 9/2014 | Hunter et al. |
| 2014/0308667 A1 | 10/2014 | Umbarger |
| 2014/0318274 A1 | 10/2014 | Zimmerman et al. |
| 2014/0342354 A1 | 11/2014 | Evans et al. |
| 2014/0361022 A1 | 12/2014 | Finneran |
| 2015/0051085 A1 | 2/2015 | Vogelstein et al. |
| 2015/0056613 A1 | 2/2015 | Kural |
| 2015/0111208 A1 | 4/2015 | Umbarger et al. |
| 2015/0178445 A1 | 6/2015 | Cibulskis et al. |

(56) References Cited

U.S. PATENT DOCUMENTS

| | | |
|---|---|---|
| 2015/0258170 A1 | 9/2015 | McCabe et al. |
| 2015/0299767 A1 | 10/2015 | Armour et al. |
| 2015/0310163 A1 | 10/2015 | Kingsmore et al. |
| 2015/0354003 A1 | 12/2015 | Umbarger |
| 2016/0003812 A1 | 1/2016 | Porreca et al. |
| 2016/0034638 A1 | 2/2016 | Spence et al. |
| 2016/0068889 A1 | 3/2016 | Gole et al. |
| 2016/0188793 A1 | 6/2016 | Muzzey et al. |
| 2016/0210486 A1 | 7/2016 | Porreca et al. |
| 2016/0251719 A1 | 9/2016 | Umbarger |
| 2017/0044610 A1 | 2/2017 | Johnson |
| 2017/0129964 A1 | 5/2017 | Cheung |
| 2017/0183731 A1 | 6/2017 | Mann et al. |
| 2017/0275676 A1 | 9/2017 | Umbarger |
| 2018/0371533 A1 | 12/2018 | Gore et al. |
| 2019/0233881 A1 | 8/2019 | Umbarger et al. |
| 2020/0181696 A1 | 6/2020 | Porreca et al. |

FOREIGN PATENT DOCUMENTS

| | | | |
|---|---|---|---|
| EP | 10770071.8 | 11/2010 | |
| EP | 2437191 A2 | 4/2012 | |
| EP | 2425240 A4 | 12/2012 | |
| WO | 1995/011995 A1 | 5/1995 | |
| WO | WO-9511995 A1 * | 5/1995 | ............. B82Y 30/00 |
| WO | 1996/019586 A1 | 6/1996 | |
| WO | 1998/014275 A1 | 4/1998 | |
| WO | 1998/044151 A1 | 10/1998 | |
| WO | 2000/018957 A1 | 4/2000 | |
| WO | 2002093453 A2 | 11/2002 | |
| WO | 2004/018497 | 3/2004 | |
| WO | 2004018497 A2 | 3/2004 | |
| WO | 2004/083819 A2 | 9/2004 | |
| WO | 2005/003304 A2 | 1/2005 | |
| WO | 2007/010251 A2 | 1/2007 | |
| WO | 2007/061284 A1 | 5/2007 | |
| WO | 2007/107717 A1 | 9/2007 | |
| WO | 2007/123744 | 11/2007 | |
| WO | 2007/135368 A2 | 11/2007 | |
| WO | 2008067551 A2 | 6/2008 | |
| WO | 2009/036525 A2 | 3/2009 | |
| WO | 2010024894 A1 | 3/2010 | |
| WO | 2010126614 A2 | 11/2010 | |
| WO | 2011066476 A1 | 6/2011 | |
| WO | 2011067378 A1 | 6/2011 | |
| WO | 2012040387 A1 | 3/2012 | |
| WO | 2012/051208 A2 | 4/2012 | |
| WO | 2012/087736 A1 | 6/2012 | |
| WO | 2012/109500 A2 | 8/2012 | |
| WO | 2012/134884 A1 | 10/2012 | |
| WO | 2013/058907 A1 | 4/2013 | |
| WO | 2013/191775 A2 | 12/2013 | |
| WO | 2014/074246 A1 | 5/2014 | |

OTHER PUBLICATIONS

Over 521 references(https://scholar.google.com/scholar?q=+mips+%22molecular+inversion%22&hl=en&as_sdt=0%2C47&as_ylo=&as_yhi=2012 downloaded .Sep. 9, 2019).*
Nilsson (Trends in Biotechnology (2006) vol. 24, pp. 83-88).*
Streit (Molecular Genetics and Metolism (2003) vol. 259-264).*
Messiaen (Genetics in Medicine, 1999:1(6):248-253.).*
Daly (Clinical Chemistry (2007) vol. 53, pp. 1222-1230) (.*
Hardenbohl (Genome Research (2005) vol. 15, pp. 269-275).*
Mockler (Genomics (2005) vol. 85, pp. 1-15).*
Jares (Clin Tral Oncology (2006)0 volume 8, pp. 161-172).*
Johnson (Trends in Genetics (2005) vol. 21, pp. 93-102).*
Wang (Genome Biology (2007) vol. 8: R246, pp. 1-14).*
Shoemaker (Nature l vol. 409 l Feb. 15, 2001, pp. 922-926).*
Urban (Proceedings National Academy of Sciences (2006) vol. 103, pp. 4534-4539.*

Wang et al. Analysis of molecular inversion probe performance for allele copy number, Genome Biology, 2007, 8: R246, pp. 1-14 (Year: 2007).*
International Search Report and Written Opinion for PCT/US13/61691 mailed Jan. 10, 2014 (10 pages).
International Search Report and Written Opinion for PCT/US2013/036575 dated Aug. 12, 2013, 10 pages.
International Search Report and Written Opinion for PCT/US2013/044039 mailed Nov. 1, 2013, (15 pages).
International Search Report and Written Opinion for PCT/US2015/056037 mailed Dec. 23, 15; 11 pages.
International Search Report and Written Opinion mailed on Jan. 29, 2015, for Patent Application No. PCT/US14/61138, filed Oct. 17, 2014, (11 pages).
International Search Report and Written Opinion mailed Jun. 10, 2013 for related application PCT/US13/33435 with an International filing date of Mar. 22, 2013 (7 pages).
International Search Report and Written Opinion mailed Dec. 2, 2015, for International Patent Application No. PCT/US2015/049132 with Internaional Filing Date Sep. 9, 2015 (14 pages).
International Search Report and Written Opinion mailed Jan. 22, 2016, for International Patent Application No. PCT/US2015/050964, filed Sep. 18, 2015 (6 pages).
International Search Report and Written Opinion mailed Jan. 7, 2015, for International Patent Application No. PCT/US14/60256, filed Oct. 13, 2014 (9 pages).
International Search Report and Written Opinion mailed May 4, 2016, for International patent application No. PCT/US2016/012886 with international filing date Jan. 6, 2015 (7 pages).
International Search Report and Written Opinion mailed Nov. 16, 2015, for International Application No. PCT/US2015/045247 with International Filing Date Aug. 14, 2015 (10 pages).
International Search Report and Written Opinion mailed on Jan. 29, 2015, for Patent Application No. PCT/US2014/060056, filed Oct. 10, 2014, (14 pages).
International Search Report and Written Opinion mailed on Mar. 18, 2015, for Patent Application No. PCT/US14/40516, filed Jun. 2, 2014 (16 pages).
International Search Report and Written Opinion mailed on May 2, 2016, for International Patent Application No. PCT/US2016/013346, filed Jan. 14, 2016 (7 pages).
International Search Report and Written Opinion mailed Sep. 2, 2015 for International Patent Application No. PCT/US2015/030366, filed May 12, 2015 (12 pages).
International Search Report and Written Opinion of the International Searching Authority mailed Dec. 13, 2016 for International Application No. PCT/US2016/051928 (14 Pages).
International Search Report and Written Opinion of the International Searching Authority mailed Jun. 12, 2017 for International Application No. PCT/US2017/016498 (12 Pages).
International Search Report for PCT/US12/55362 mailed Feb. 25, 2013, p. 15.
Isosomppi, 2009, Disease-causing mutations in the CLRN1 gene alter normal CLRN1 protien trafficking to the plasma membrane, Mol Vis 15:1806-1818.
Jensen, 2001, Orthologs and paralogs—we need to get it right, Genome Biol 2(8):1002-1002.3.
Kambara et al., Optimization of Parameters in a DNA Sequenator Using Fluorescence Detection, Nature Biotechnology 6:816-821 (1988).
Kennedy et al., 2013, Accessing more human genetic variation with short sequencing reads, American Society of Human Genetics 63rd Annual Meeting, Abstract, Oct. 22, 2013.
Kerem, 1989, Identification of the cystic fibrosis gene: genetic analysis, Science 245:1073-1080.
Kinde, 2012, FAST-SeqS: a simple an effective method for detection of aneuploidy by massively parallel sequencing, PLoS One 7(7):e41162.
Kneen, 1998, Green fluorescent protein as a noninvasive intracellular pH indicator, Biophys J 74(3):1591-99.
Koboldt, 2009, VarScan: variant detection in massively parallel sequencing of individual and pooled samples, Bioinformatics 25:2283-85.

(56) References Cited

OTHER PUBLICATIONS

Li, 2010, Fast and accurate long-read alignment with Burrows-Wheeler transform, Bioinformatics 26(5):589-95.
Li, 2011, Improving SNP discovery by base alignment quality, Bioinformatics 27:1157.
Li, 2012, A new approach to detecting low-level mutations in next-generation sequence data, Genome Biol 13:1-15.
Li, 2014, HUGO: Hierarchical mUlti-reference Genome compression for aligned reads, JAMIA 21:363-373.
Lin, 2008, ZOOM! Zillions of Oligos Mapped, Bioinformatics 24:2431.
Lin, 2010, A molecular inversion prove assay for detecting alternative splicing, BMC Genomics 11(712):1-14.
Liu, 2012, Comparison of next-generation sequencing systems, J Biomed Biotech 2012:251364.
Llopis, 1998, Measurement of cytosolic, mitochondrial, and Golgi pH in single living cells with green fluorescent proteins, PNAS 95(12):6803-08.
Ma, 2006, Application of real-time polymerase chain reaction (RT-PCR), J Am Soc 1-15.
MacArthur, 2014, Guidelines for investigating causality of sequence variants in human disease, Nature 508:469-76.
Maddalena, 2005, Technical standards and guidelines: molecular genetic testing for ultra-rare disorders, Genet Med 7:571-83.
Malewicz, 2010, Pregel: a system for large-scale graph processing, Proc. ACM SIGMOD Int Conf Mgmt Data 135-46.
McDonnell, "Antisepsis, disinfection, and sterilization: types, action, and resistance," p. 239 (2007).
McKenna, 2010, The Genome Analysis Toolkit: a MapReduce framework for analyzing next-generation DNA sequencing data, Genome Res 20(9):1297-1303.
Meyer, 2007, Targeted high-throughput sequencing of tagged nucleic acid samples, Nucleic Acids Research 35(15):e97 (5 pages).
Meyer, 2008, Parallel tagged sequencing on the 454 platform, Nature Protocols 3(2):267-78.
Miller, 2010, Assembly algorithms for next-generation sequencing data, Genomics 95:315-327.
Miner, 2004, Molecular barcodes detect redundancy and contamination in hairpin-bisulfite PCR, Nucl Acids Res 32 (17):e135.
Miyazaki, 2009, Characterization of deletion breakpoints in patients with dystrophinopathy carrying a deletion of exons 45-55 of the Duchenne muscular dystrophy (DMD) gene, J Hum Gen 54:127-30.
Adey, 2010, Rapid, low-input, low-bias construction of shotgun fragment libraries by high-density in vitro transposition, Genome Biol 11:R119.
Agrawal, 1990, Site-specific functionalization of oligodeoxynucleotides for non-radioactive labelling, Tetrahedron Let 31:1543-1546.
Akhras, 2007, PathogenMip Assay: A Multiplex Pathogen Detection Assay, PLoS ONE 2(2): e223.
Archer, 2014, Selective and flexible depletion of problematic sequences from RNA-seq libraries at the cDNA stage, BMC Genomics 15(1):401.
Balzer, 2013, Filtering duplicate reads from 454 pyrosequencing data, Bioinformatics 29(7):830-836.
Beer, 1962, Determination of base sequence in nucleic acids with the electron microscope: visibility of a marker, PNAS 48(3):409-416.
Bell, 2011, Carrier testing for severe childhood recessive diseases by next-generation sequencing, Sci Trans Med 3 (65ra4).
Bonfield, 2013, Compression of FASTQ and SAM format sequencing data, PLoS One 8(3):e59190.
Bose, 2012, BIND—An algorithm for loss-less compression of nucleotide sequence data, J Biosci 37(4):785-789.
Boyden, 2013, High-throughput screening for SMN1 copy number loss by next-generation sequencing, American Society of Human Genetics 63rd Annual Meeting, Abstract, Oct. 22, 2013.
Brinkman, 2004, Splice Variants as Cancer Biomarkers, Clin Biochem 37:584.
Brownstein, 2014, An international effort towards developing standards for best practices in analysis, interpretation and reporting of clinical genome sequencing results in the CLARITY Challenge, Genome Biol 15:R53.
Carpenter, 2013, Pulling out the 1%: whole-genome capture for the targeted enrichment of ancient DNA sequencing libraries, Am J Hum Genet 93(5):852-864.
Caruthers, 1985, Gene synthesis machines: DNA chemistry and its uses, Science 230:281-285.
Challis, 2012, An integrative variant analysis suite for whole exome next-generation sequencing data, BMC Informatics 13(8):1-12.
Chen, 2010, Identification of racehorse and sample contamination by novel 24-plex STR system, Forensic Sci Int: Genetics 4:158-167.
Cock, 2010, The Sanger FASTQ file format for sequences with quality scores, and the Solexa/Illumina FASTQ variants, Nucleic Acids Res 38(6):1767-1771.
Cremers, 1998, Autosomal Recessive Retinitis Pigmentosa and Cone-Rod Dystrophy Caused by Splice Site Mutations In the Stargardt's Disease Gene ABCR, Hum Mol Gen 7(3):355.
Cronin, 1996, Cystic Fibrosis Mutation Detection by Hybridization to Light-Generated DNA Probe Arrays Human Mutation 7:244.
Danecek, 2011, The variant call format and VCFtools, Bioinformatics 27(15):2156-2158.
Den Dunnen, 2003, Mutation Nomenclature, Curr Prot Hum Genet 7.13.1-7.13.8.
Deorowicz, 2013, Data compression for sequencing data, Alg for Mole Bio 8:25.
Dolinsek, 2013, Depletion of unwanted nucleic acid templates by selection cleavage: LNAzymes, catalytically active bligonucleotides containing locked nucleic acids, open a new window for detecting rare microbial community members, App Env Microbiol 79(5):1534-1544.
Drmanac, 1992, Sequencing by hybridization: towards an automated sequencing of one million M13 clones arrayed on membranes, Elctrophoresis 13:566-573.
Extended European Search Report mailed Oct. 26, 2016 for EP 14762322.7 (11 pages).
Faust, 2014, SAMBLASTER: fast duplicate marking and structural variant read extraction, Bioinformatics published online May 7, 2014.
Fitch, 1970, Distinguishing homologs from analogous proteins, Syst Biol 19(2):99-113.
Furtado, 2011, Characterization of large genomic deletions in the FBN1 gene using multiplex ligation-dependent probe amplification, BMC Med Gen 12:119-125.
Garber, 2008, Fixing the front end, Nat Biotech 26(10):1101-1104.
Giusti, 1993, Synthesis and Characterization of f'-Fluorescent-dye-labeled Oligonucleotides, PCR Meth Appl 2:223-227.
Green, 2005, Suicide polymerase endonuclease restriction, a novel technique for enhancing PCR amplification of minor DNA template, Appl Env Microbiol 71(8):4721-4727.
Guerrero-Fernandez, 2013, FQbin: a compatible and optimize dformat for storing and managing sequence data, WBBIO Proceedings, Granada 337-344.
Gupta, 1991, A general method for the synthesis of 3'-sulfhydryl and phosphate group containing oligonucleotides, Nucl Acids Res 19(11):3019-3025.
Gustincich et al., 1991, A fast method for high-quality genomic DNA extraction from whole human blood, BioTechniques 11(3):298-302.
Hallam, 2014, Validation for Clinical Use of, and Initial Clinical Experience with, a Novel Approach to Population-Based Carrier Screening using High-Throughput Next-Generation DNA Sequencing, J Mol Diagn 16:180-9.
Hardenbol, 2005, Highly multiplexed molecular inversion probe genotyping: over 10,000 targeted SNPs genotyped in a single tube assay, Genome Res 15:269-75.
Harris, 2008, Helicos True Single Molecule Sequencing (tSMS) Science 320:106-109.
Heger, 2006, Protonation of Cresol Red in Acidic Aqueous Solutions Caused by Freezing, J Phys Chem B 110 (3):1277-1287.
Heid, 1996, Real time quantitative PCR, Genome Res 6:986-994.

(56) References Cited

OTHER PUBLICATIONS

Tiatt, 2013, Single molecule molecular inversion probes for targeted, high-accuracy detection of low-frequency variation, Genome Res 23:843-54.
Homer et al., 2008, Resolving Individuals Contributing Trace Amounts of DNA to Highly Complex Mixtures Using High-Density SNP Genotyping Microarrays. PLoS One 4(8):e1000167.
Homer, 2009, BFAST: An alignment tool for large scale genome resequencing, PLoS ONE 4(11):e7767.
Housley, 2009, SNP discovery and haplotype analysis in the segmentally duplicated DRD5 coding region, Ann Hum Genet 73(3):274-282.
Illumina, 2010, De Novo assembly using Illumina reads, Technical Note (8 pages).
International Preliminary Report on Patentability for WO 2010/126614.
International Search Report and Written Opinion for PCT/US12/29790, mailed Jun. 14, 2012 17 pages.
International Search Report and the Written Opinion of the International Searching Authority Mailed Dec. 23, 2015 for International Application No. PCT/US2015/056037 (13 Pages).
International Search Report and Written Opinion for international application No. PCT/US13/62842 with international filing date Oct. 1, 2013, ISR/WO mailed Feb. 4, 2014 (10 pages).
Mohammed, 2012, DELIMINATE—a fast and efficient methods for loss-less compression of genomice sequences, Bioinformatics 28(19):2527-2529.
Munne, 2012, Preimplantation genetic diagnosis for aneuploidy and translocations using array comparative genomic hybridization, Curr Genomics 13(6):463-470.
Nelson, 1989, Bifunctional oligonucleotide probes synthesized using a novel CPG support are able to detect single base pair mutations, Nucl Acids Res 17(18):7187-7194.
Nuttle, 2013, Rapid and accurate large-scale genotyping of duplicated genes and discovery of interlocus gene conversions, Nat Meth 10(9):903-909.
Nuttle, 2014, Resolving genomic disorder-associated breakpoints within segmental DNA duplications using massively parallel sequencing, Nat Prot 9(6):1496-1513.
O'Roak, 2012, Multiplex targeted sequencing identifies recurrently mutated genes in autism spectrum disorders, Science 338(6114):1619-1622.
Okoniewski, 2013, Precise breakpoint localization of large genomic deletions using PacBio and Illumina next- generation sequencers, Biotechniques 54(2):98-100.
Parkinson, 2012, Preparation of high-quality next-generation sequencing libraries from picogram quantities of target DNA, Genome Res 22:125-133.
Pastor, 2010, Conceptual modeling of human genome mutations: a dichotomy between what we have and what we shoudl have, 2010 Proc BIOSTEC Bioinformatics, pp. 160-166.
Paton, 2000, Conceptual modelling of genomic information, Bioinformatics 16(6):548-57.
Pinho, 2013, MFCompress: a compression tool for FASTA and multi-FASTA data, Bioinformatics 30(1):117-8.
Porreca, 2013, Analytical performance of a Next-Generation DNA sequencing-based clinical workflow for genetic carrier screening, American Society of Human Genetics 63rd Annual Meeting, Abstract, Oct. 22, 2013.
Qiagen, 2011, Gentra Puregene handbook, 3d Ed. (72 pages).
Richards, 2008 ACMG recommendations for standards for interpretation and reporting of sequence variations: Revisions, Genet Med 10(4):294-300.
Rodriguez, 2010, Constructions from Dots and Lines, Bull Am Soc Inf Sci Tech 36(6):35-41.
Schiffman, 2009, Molecular inversion probes reveal patterns of 9p21 deletion and copy number aberrations in childhood leukemia, Cancer Genetics and Cytogenetics 193:9-18.
Schneeberger, 2011, Reference-guided assembly of four diverse Arabidopsis thaliana genomes, PNAS 108 (25):10249-10254.
Schouten, 2002, Relative Quantification of 40 Nucleic Acid Sequences by Multiplex Ligation-Dependent Probe Amplification, Nucle Acids Res 30 (12):257.
Shen, 2013, Multiplex capture with double-stranded DNA probes, Genome Medicine 5(50):1-8.
Smith, 1985, The synthesis of oligonucleotides containing an aliphatic amino group at the 5' terminus: synthesis of fluorescent DNA primers for use in DNA sequence analysis, Nucl. Acid Res., 13:2399-2412.
Smith, 2010, Highly-multiplexed barcode sequencing: an efficient method for parallel analysis of pooled samples, Nucleic Acids Research 38(13):e142 (8 pages).
Sproat, 1987, The synthesis of protected 5'-mercapto-2',5'-dideoxyribonucleoside-3'-O-phosphoramidites; uses of 5'-mercapto-oligodeoxyribonucleotides, Nucl Acid Res 15:4837-4848.
Strom, 2005, Mutation detection, interpretation, and applications in the clinical laboratory setting, Mutat Res 573:160-67.
Summerer, 2010, Targeted High Throughput Sequencing of a Cancer-Related Exome Subset by Specific Sequence Capture With a Fully Automated Microarray Platform, Genomics 95(4):241-246.
Supplementary European search report and opinion dated Oct. 13, 2016, for EP 14762322 (8 pages).
Tan, 2014, Clinical outcome of preimplantation genetic diagnosis and screening using next generation sequencing, GigaScience 3(30):1-9.
Tkachuk, 1990, Detection of bcr-abl Fusion in Chronic Myelogeneous Leukemia by in Situ Hybridization, Science 250:559.
Tobler, 2005, The SNPlex Genotyping System: A Flexible and Scalable Platform for SNP Genotyping, J Biomol Tech 16(4):398.
Umbarger, 2013, Detecting contamination in Next Generation DNA sequencing libraries, American Society of Human Genetics 63rd Annual Meeting, Abstract, Oct. 22, 2013.
Umbarger, 2014, Next-generation carrier screening, Gen Med 16(2):132-140.
Veeneman, 2012, Oculus: faster sequence alignment by streaming read compression, BMC Bioinformatics 13:297.
Wallace, 1987, Oligonucleotide probes for the screening of recombinant DNA libraries, Meth Enz 152:432-442.
Wang et al., 2005, Allele quantification using molecular inversion probes (MIP), Nucleic Acids Research 33(21):e183.
Waszak, 2010, Systematic inference of copy-No. genotypes from personal genome sequencing data reveals extensive olfactory gene content diversity, PLoS Comp Biol 6(11):e1000988.
Xu, 2012, FastUniq: A fast de novo duplicates removal tool for paired short reads, PLoS One 7(12):e52249.
Ye, 2009, Pindel: a pattern growth approach to detect break points of large deletions and medium size insertions from paired-end short reads, Bioinformatics 25(21):2865-2871.
Yershov, 1996, DNA analysis and diagnostics on oligonucleotide microchips, PNAS 93:4913-4918.
Yoon, 2014, MicroDuMIP: target-enrichment technique for microarray-based duplex molecular inversion probes, Nucl Ac Res 43(5):e28.
Zhou, 2014, Bias from removing read duplication in ultra-deep sequencing experiments, Bioinformatics 30(8):1073-1080.
Zuckerman, 1987, Efficient methods for attachment of thiol specific probes to the 3'-ends of synthetic bligodeoxyribonucleotides, Nucl Acid Res 15(13):5305-5321.
Akhras, 2007, Connector inversion probe technology: A powerful one-primer multiplex DNA amplification system for numerous scientific applications, PLoSOne 9:e915.
Meyer, 2008, Parallel tagged sequencing on the 454 platform, Nat Protocol 3(2):267-278.
Bhangale, 2006, Automating resequencing-based detection of insertion-deletion polymorphisms, Nature Genetics 38:1457-1462.
Li, 2003, DNA binding and cleavage by the periplasmic nuclease Vvn: a novel structure with a known active site, EMBO J 22(15):4014-4025.
Wahl, 1979, Efficient transfer of large DNA fragments from agarose gels to diazobenzyloxymethyl-paper and rapid hybridization by using dextran sulfate, PNAS 76:3683-3687.

(56) References Cited

OTHER PUBLICATIONS

Chennagiri, 2013, A generalized scalable database model for storing and exploring genetic variations detected using sequencing data, American Society of Human Genetics 63rd Annual Meeting, Abstract, Oct. 22, 2013.
Chevreux, 1999, Genome sequence assembly using trace signals and additional sequence information, Proc GCB 99:45-56.
Frey, 2006, Statistics Hacks 108-115.
Goto, 1994, A Study on Development of a Deductive Object-Oriented Database and Its Application to Genome Analysis, PhD Thesis, Kyushu University, Kyushu, Japan (106 pages).
Guerrero-Fernandez, 2013, FQbin: a compatible and optimize dformat for storing and managing sequence data, IWBBIO Proceedings, Granada 337-344.
Gustincich, 1991, A fast method for high-quality genomic DNA extraction from whole human blood, BioTechniques 11(3):298-302.
Homer, 2008, Resolving Individuals Contributing Trace Amounts of DNA to Highly Complex Mixtures Using High-Density SNP Genotyping Microarrays. PLoS One 4(8):e1000167.
Kambara, 1988, Optimization of Parameters in a DNA Sequenator Using Fluorescence Detection, Nature Biotechnology 6:816-821.
Kennedy, 2013, Accessing more human genetic variation with short sequencing reads, American Society of Human Genetics 63rd Annual Meeting, Abstract, Oct. 22, 2013.
Larkin, 2007, Clustal W and Clustal X version 2.0, Bioinformatics, 23(21):2947-2948.
Lipman, 1985, Rapid and sensitive protein similarity searches, Science 227(4693):1435-41.
May 1988, How Many Species Are There on Earth?, Science 241(4872):1441-9.
Miesenbock, 1998, Visualizing secretion and synaptic transmission with pH-sensitive green fluorescent proteins, Nature 394(6689):192-95.
Moudrianakis, 1965, Base Sequence Determination in Nucleic Acids with the Electron Microscope, III. Chemistry and Microscopy of Guanine-Labeled DNA, PNAS, 53:564-71.
Rosendahl, 2013, CFTR, SPINK1, CTRC and PRSS1 variants in chronic pancreatitis: is the role of mutated CFTR overestimated?, Gut 62:582-592.
Sunnucks, 1996, Microsatellite and chromosome evolution of parthenogenetic sitobion aphids in Australia, Genetics 144:747-756.
Abravaya, 1995, Detection of point mutations with a modified ligase chain reaction (Gap-LCR), Nucleic Acids Research, 23(4): 675-682.
Supplemental information) Final Rejection issued in U.S. Appl. No. 13/266,862, date of mailing: Jun. 9, 2020, 33 pages.
Blasczyk, 1996, Sequence analysis of the 2nd intron revealed common sequence motifs providing the means for a unique sequencing based typing protocol of the HLA-A locus, Tissue Antigens, 47:102-110.
Brinkman, 2004, Splice Variants as Cancer Biomarkers, Clin Biochem 37:584-594.
Cremers, 1998, Autosomal Recessive Retinitis Pigmentosa and Cone-Rod Dystrophy Caused by Splice Site Mutations In the Stargardt's Disease Gene ABCR, Hum Mol Gen 7(3):355-362.
Cronin, 1996, Cystic Fibrosis Mutation Detection by Hybridization to Light-Generated DNA Probe Arrays Human Mutation 7:244-255.
Daly, 2007, Multiplex Assay for Comprehensive Genotyping of Genes Involved in Drug Metabolism, Excretion, and Transport, Clinical Chemistry, 53:7:1222-1230.
Deng, 2012, Supplementary Material, Nature Biotechnology, S1-1-S1-1 1, Retrieved from the Internet on Oct. 24, 2012, 12 pages.
Dou, 2012, Reference-free SNP calling: improved accuracy by preventing incorrect calls from repetitive genomic regions, Biology Direct 7:17.
Fu, 2010, Repeat subtraction-mediated sequence capture from a complex genome, The Plant Journal, 62:898-909.
Gupta, 2014, Expanding the genetic toolkit: ZFNs, TALENs, and CRISPR-Cas9, J Clin Invest 124(10):4154-4161.
Lin, 2008, ZOOM! Zillions of Oligos Mapped, Bioinformatics 24:2431-2437.
Meyer, 2008, Parallel tagged sequencing on the 454 platform, Nature Protocols, 3(2):267-278.
Schiffman, 2007, Adapting molecular inversion probe (MIP) technology for allele quantification in childhood leukemia, Journal of Clinical Oncology, 25, p530, 5 pages. abs only.
Shagin, 2002, A novel method for SNP detection, Genome Res 12:1935-1942.
Sonnhammer, 2002, Orthology, paralogy and proposed classification for paralog subtypes, Trends in Genetics, 18(12):619-620.
Tarhini, 2018, Predictive and on-treatment monitoring biomarkers in advanced melanoma: Moving toward personalized medicine, Cancer Treatment Reviews, 71:8-18.
Tobler, 2005, The SNPlex Genotyping System: A Flexible and Scalable Platform for SNP Genotyping, J Biomol Tech 16(4):398-406.
Wang, 2007, Analysis of molecular inversion probe performance for allele copy number determination, Genome Biology, 8(11):R246.1-R246.14.
Wittung, 1997, Extended DNA-Recognition Repertoire of Peptide Nucleic Acid (PNA): PNA-dsDNA Triplex Formed with Cytosine-Rich Homopyrimidine PNA, Biochemistry 36:7973-7979.
Chaisson, 2004, Fragment assembly with short reads, Bionormatics, 20:2067-2074.
Collins, 2004, Finishing the euchromatic sequence of the human genome, Nature 431(7011):931-45.
Kotsch, 1999, Sequencing of HLA class II genes based on the conserved diversity of the non-coding regions: sequencing based typing of HLA-DRB genes, Tissue Antigens, 53:486-497.
Thompson, et al., 2011, The properties and applications of single-molecule DNA sequencing, Genome Biology 12(2):217, 10 pages.
Australian Patent Examination Report No. 1 issued Aug. 12, 2014, for Australian Patent Application No. 2010242073 filed Apr. 30, 2010, 4 pages.
International Search Report and Written Opinion mailed on Sep. 3, 2014 for International Patent Application No. PCT/US14/27324, filed Mar. 14, 2014 (8 pages).
Supplementary European Search Report issued Aug. 26, 2014, for European Patent Application No. 12765217.0, filed Mar. 20, 2012, 5 pages.
International Search Report and Written Opinion mailed Jun. 14, 2012, for International Patent Application No. PCT/US12/29790, filed Mar. 20, 2012 (8 pages).
International Search Report and Written Opinion mailed Nov. 1, 2013, for International Patent Application No. PCT/US2013/044039, filed Jun. 4, 2013 (6 pages).
International Search Report and Written Opinion mailed on Feb. 4, 2014, for Patent Application No. PCT/US13/62842, filed Oct. 1, 2013 (5 pages).
International Search Report and Written Opinion mailed on Jun. 28, 2013, for Patent Application No. PCT/US2013/032885, filed Mar. 19, 2013 (9 pages).
International Search Report and Written Opinion mailed on Oct. 28, 2010, for Patent Application No. PCT/US2010/001293, filed Apr. 30, 2010 (8 pages).
Iqbal, et al., 2012, De novo assembly and genotyping of variants using colored de Bruijn graphs, Nature Genetics, 44(2):226-233.
Jaijo, et al., 2010, Microarray-Based Mutation Analysis of 183 Spanish Families with Usher Syndrome, Investigative Ophthalmology & Visual Science 51(3):1311-7.
Jones, et al., 2008, Core Signaling Pathways in Human Pancreatic Cancers Revealed by Global Genomic Analyses, Science 321(5897):1801-1806.
Kent, W.J., 2002, BLAT—The BLAST-like alignment tool, Genome Research 4: 656-664.
Kircher, et al., 2010, High-througput DNA sequencing—concepts and limitations, Bioassays 32:524-36.
Kirpekar, et al., 1994, Matrix assisted laser desorption/ionization mass spectrometry of enzymatically synthesized RNA up to 150 kDa, Nucleic Acids Res 22:3866-3870.

(56) References Cited

OTHER PUBLICATIONS

Klein, et al., 2011, LOCAS—a low coverage assembly tool for resequence projects, PLoS One vol. 6, Issue 8, Document e23455, Aug. 15, 2011 (10 pages).
Krawitz, et al., 2010, Microindel detection in short-read sequence data, Bioinformatics 26(6).
Kreindler, J. L., 2010, Cystic fibrosis: Exploiting its genetic basis in the hunt for new therapies, Pharmacology and Therapeutics 125(2):219-29.
Kumar, S. et al., Comparing de novo assemblers for 454 transcriptome data, Genomics 11:571 (2010).
Kurtz, S., et al., 2004, Versatile and open software for comparing large genomes, Genome Biology, 5:R12.
Lam, et al., 2008, Compressed indexing and local alignment of DNA, Bioinformatics 24(6):791-97.
Langmead, et al., 2009, Ultrafast and memory-efficient alignment of short DNA sequences to the human genome, Genome Biology, 10:R25.
Larkin M.A., et al., 2007, Clustal W and Clustal X version 2.0, Bioinformatics, 23, 2947-2948.
Lecompte, O., et al., 2001, Multiple alignment of complete sequences (MACS) in the post-genomic era, Gene 270:17-30.
Li H. & Durbin R., 2009, Fast and accurate short read alignment with Burrows-Wheeler transform, Bioinformatics, 25(14):1754-60.
Li H. & Durbin R., 2010, (2010) Fast and accurate long-read alignment with Burrows-Wheeler Transform. Bioinformatics, Epub.
Li, et al., 2008, SOAP: short oligonucleotide alignment program, Bioinformatics 24(5):713-14.
Li, et al., 2009, SOAP2: an improved ultrafast tool for short read alignment, Bioinformatics 25(15): 1966-67.
Li, et al., 2009, The Sequence Alignment/Map format and SAMtools, Bioinformatics, 2009, 25(16):2078-9.
Li, et al., 2011, Single Nucleotide Polymorphism Genotyping and Point Mutation Detection by Ligation on Microarrays, Journal of Nanoscience and Nanotechnology 11(2):994-1003.
Lin, et al., 2012, Development and evaluation of a reverse dot blot assay for the simultaneous detection of common alpha and beta thalassemia in Chinese, Blood Cells Molecules, and Diseases 48(2):86-90.
Lipman, D.J., et al., 1985, Rapid and sensitive protein similarity searches, Science 227(4693):1435-41.
Mamanova, 2010, Target-enrichment strategies for nextgeneration sequencing, Nature Methods 7(2):111-8.
Margulies, et al., 2005, Genome sequencing in microfabricated high-density picolitre reactors, Nature 437:376-380.
Marras, 1999, Multiplex detection of single-nucleotide variations using molecular beacons, Genetic Analysis: Biomolecular Engineering 14:151.
Maxam, et al., 1977, A new method for sequencing DNA, Proc. of National Academy of Science USA 74:560-4.
Mills, R.E., et al., 2010, Mapping copy number variation by population-scale genome sequencing, Nature 470:59-65.
Minton, et al., 2011, Mutation Surveyor: Software for DNA Sequence Analysis, Methods in Molecular Biology 688:143-53.
Moudrianakis E. N. & Beer M., 1965, Base sequence determination in nucleic acids with the electron microscope, PNAS, 53:564-71.
Mullan, L. J., 2002, Multiple sequence alignment-the gateway to further analysis, Brief Bioinform., 3:303-5.
Nan, et al., 2006, A novel CFTR mutation found in a Chinese patient with cystic fibrosis, Chinese Medical Journal 119(2):103-9.
Narang, et al., 1979, Improved phosphotriester method for the synthesis of gene fragments, Methods Enzymol., 68:90.
Ng, et al., 2009, Targeted capture and massively parallel sequencing of 12 human exomes, Nature 461(7261):272-6.
Nicholas, H. B. Jr., et al., 2002, Strategies for multiple sequence alignment, Biotechniques 32:572-91.
Nickerson, et al., 1990, Automated DNA diagnostics using an ELISA-based oligonucleotide ligation assay, Proc. National Academy of Science 87:8923-7.
Nielsen, et al., 1999, Peptide Nucleic Acids, Protocols and Applications (Norfolk: Horizon Scientific Press, 1-19).
Ning, Z., et al., 2001, SSAHA: a fast search method for large DNA databases, Genome Research 11(10): 1725-9 (2001).
Nordhoff, et al., 2003, Ion stability of nucleic acids in infrared matrix-assisted laser desorption/ionization mass spectrometry, Nucleic Acids Research 21(15):3347-57.
Oefner, et al., 1996, Efficient random subcloning of DNA sheared in a recirculating point-sink flow system, Nucleic Acids Research 24:3879-89.
Oka, et al., 2006, Detection of Loss of Heterozygosity in the p53 Gene in Renal Cell Carcinoma and Bladder Cancer Using the Polymerase Chain Reaction, Molecular Carcinogenesis 4(1).
Oliphant, et al., 2002, BeadArray?Technology: Enabling an Accurate, Cost-Effective Approach to High-Throughput Genotyping, Biotechniques Suppl:56-8, 60-1.
Ordahl, et al., 1976, Sheared DNA fragment sizing:comparison of techniques, Nucleic Acids Research 3:2985-99.
Owens, et al., 1998, Aspects of oligonucleotide and peptide sequencing with MALDI and electrospray mass spectrometry, Bioorg Med Chem 6:1547-1554.
Parameswaran, et al., 2007, A pyrosequencing-tailored nucleotide barcode design unveils opportunities for large-scale sample multiplexing, Nucleic Acids Research 35:e130, pp. 1-9.
Akhras, M.S., et al., "Connector Inversion Probe Technology: A Powerful One-Primer Multiplex DNA Amplification System for Numerous Scientific Applications," PLoS ONE (2007) 2(9):e915, 6 pages.
Ball, M.P., et al., "Targeted and genome-scale strategies reveal gene-body methylation signatues in human cells," Nature Biotechnology, (2009) 27(4):361-368.
Bau, S., et al., "Targeted next-generation sequencing by specific capture of multiple genomicmicrofluidic DNA arrays," Anal Bioanal Chem (2009) 393:171-175.
Deng, J., et al., "Targeted bisulfite sequencing reveals changes in DNA methylation associated with nuclear reprogramming," Nature Biotechnology (2009) 27(4):353-360.
Deng, J., et al., Nature Biotechnology: doi:10.1038/nbt. 1530, SUPPLEMENT, 11 pages.
European Search Report for EP Application No. 10770071.8 dated Nov. 8, 2012, 17 pages.
Examination Report from the European Patent Office for EP 10770071.8 dated Jul. 16, 2013, 5 pages.
Hardenbol, P., "Multiplexed genotyping with sequence-tagged molecular inversion probes," Nature Biotechnology (2003) 21:(6):673-678.
Harris, N.C., et al., "Defects Can Increase the Melting Temperature of DNA—Nanoparticle Assemblies," J. Phys. Chem. B (2006) 110, 16393-16396.
International Preliminary Report on Patentability for PCT/US2010/001293 dated Nov. 1, 2011, 9 pages.
International Search Report for PCT/US10/01293 dated Oct. 28, 2010, 4 pages.
Krishnakumar, S., et al., "A comprehensive assay for targeted multiplex amplification of human DNA sequences," Proceedings of the National Academy of Sciences (2008) 105(27):9296-9301.
Mockler, T., et al., "Applications of DNA tiling arrays for whole-genome analysis," Genomics (2005) 85:1-15.
Nilsson et al (Trends in Biotechnology (2006) vol. 24, pp. 83-88).
Porreca, G., et al., "Multiplex amplification of large sets of human exons," Nature Methods (2007) 4(11): 931-936.
Turner, E.H., "Massively parallel exon capture and library-free resequencing across 16 genomes," Nature Methods (2009) 6(5):315-316.
Turner, E.H., et al., Nature Methods: doi: 10.1038/nmeth.f.248, SUPPLEMENT, 12 pages.
Pearson W.R., et al., Improved tools for biological sequence comparison, PNAS 85(8):2444-8 (1988).
Pertea, et al., TIGR gene indices clustering tools (TGICL), Bioinformatics 19(5):651-52 (2003).
Pieles, et al., 1993, Matrix-assisted laser desorption ionization time-of-flight mass spectrometry: A powerful tool for the mass and sequence analysis of natural and modified oligonucleotides, Nucleic Acids Res 21:3191-3196.

(56) References Cited

OTHER PUBLICATIONS

Procter, et al., 2006, Molecular Diagnosis of Prader-Willi and Angelman Syndromes by Methylation-Specific Melting Analysis and Methylation-Specific Multiplex Ligation-Dependent Probe Amplification, Clinical Chemistry 52(7):1276-83.
Quail, et al., 2010, DNA: Mechanical Breakage, Encyclopedia of Life Sciences 2010.
Rambaut, et al., 1997, Seq-Gen:an application for the Monte Carlo simulation of DNA sequence evolution along phylogenetic trees, Bioinformatics (formerly CABIOS) 13:235-38.
Richter, et al., 2008, MetaSim—A Sequencing Simulator for Genomics and Metagenomics, PLOS ONE 3:e3373.
Roberts, R.J., 1980, Restriction and modification enzymes and their recognition sequence, Nucleic Acids Research 8(1):r63-r80.
Rosendahl, et al., 2013, CFTR, SPINK1, CTRC and PRSS1 variants in chronic pancreatitis: is the role of mutated CFTR over estimated?, Gut 62:585-92.
Rothberg, et al., 2011, An integrated semiconductor device enablingnon-optical genome sequencing, Nature 475:348-52.
Rowntree, et al., 2003, The Phenotypic Consequences of CFTR Mutations, Annals of Human Genetics 67:471-85.
Sanger, et al., 1977, DNA sequencing with chain-terminating inhibitors, Proc.National Academy of Science USA 74(12):5463-7.
Santa Lucia, John Jr., 1998, A unified view of polymer, dumbbell, and oligonucleotide DNA nearest-neighbor thermodynamics, Proc. National Academy of Science USA 95:1460-5.
Sargent, T.D., 1988, Isolation of Differentially Expressed Genes, Methods in Enzymology 152:432.
Sauro, 2004, How Do You Calculate a Z-Score/ Sigma Level?, https://www.measuringusability.com/zcalc.htm (online publication).
Sauro, 2004, What's a Z-Score and Why Use it in Usability Testing?, https://www.measuringusability.com/z.htm (online publication).
Schadt, et al., 2010, A window into third-generation sequencing, Human Molecular Genetics 19(R2):R227-40.
Schatz, et al., Assembly of large genomes using second-generation sequencing, Genome Res., 20:1165-1173 (2010).
Schrijver, et al., 2005, Diagnostic Testing by CFTR Gene Mutation Analysis in a Large Group of Hispanics, The Journal of Molecular Diagnostics 7:289-99.
Schuette, et al., 1995, Sequence analysis of phosphorothioate oligonucleotides via matrix-assisted laser desorption ionization time-of-flight mass spectrometry, J. Pharm. Biomed. Anal 13:1195-1203.
Schwartz, et al., 2009, Identification of Cystic Fibrosis Variants by Polymerase Chain Reaction/Oligonucleotide Ligation Assay, The Journal of Molecular Diagnostics 11(3):211-15.
Schwartz, Stuart, 2011, Clinical Utility of Single Nucleotide Polymorphism Arrays, Clinics in Laboratory Medicine 31(4):581-94.
Sequeira, et al., 1997, Implementing generic, object-oriented models in biology, Ecological Modeling 94.1:17-31.
Sievers F., et al., Fast, scalable generation of high-quality protein multiple sequence alignments using Clustal Omega, Mol Syst Biol 7:539 (2011).
Simpson, J.T., et al., ABySS: A parallel assembler for short read sequence data, Genome Res., 19(6):1117-23 (2009).
Slater, G., and Birney, E., Automated generation of heuristics for biological sequence comparison, BMC Bioinformatics 6:31 (2005).
Soni, G. V., and Meller, A., Progress toward ultrafast DNA sequencing using solid-state nanopores, Clin Chem 53:1996-2001 (2007).
Spanu, P.D., et al., Genome expansion and gene loss in powdery mildew fungi reveal tradeoffs in extreme parasitism, Science 330(6010):1543-46 (2010).
Summerer, Daniel, 2009, Enabling technologies of genomic-scale sequence enrichment for targeted high-throughput sequencing, Genomics 94:363-8.
Sunnucks, et al., 1996, Microsatellite and Chromosome Evolution of Parthenogenetic Sitobion Aphids in Australia, Genetics Society of America 144:747-56.
Thauvin-Robinet, et al., 2009, The very low penetrance of cystic fibrosis for the R117H mutation: a reappraisal for genetic counselling and newborn screening, Journal of Medical Genetics 46:752-8.
Thompson, et al., Clustal W: improving the sensitivity of progressive multiple sequence alignment through sequence weighting, position-specific gap penalities and matrix choice, Nucl. Acids. Res., 22:4673-80 (1994).
Thorstenson, et al., 1998, An Automated Hydrodynamic Process for Controlled, Unbiased DNA Shearing, Genome Methods 8:848-55.
Thorvaldsdottir, et al., 2012, Integrative GenomicsViewer (IGV): high-performance genomics data visualization and exploration, Briefings in Bioinformatics 24(2):178-92.
Tokino, 1996, Characterization of the human p57 KIP2 gene: alternative splicing, insertion/deletion polymorphisms in VNTR sequences in the coding region, and mutational analysis, Human Genetics 96:625-31.
Turner, et al., 2009, Methods for Genomic Partitioning, Annual Review of Genomics and Human Genetics 10:263-84.
Wallace, et al., 1979, Hybridization of synthetic oligodeoxyribonucteotides to dp x 174DNA:the effect of single base pair mismatch, Nucleic Acids Research 6:3543-3557.
Warner, et al., 1996, A general method for the detection of large CAG repeat expansions by fluorescent PCR, Journal Medical Genetics 33(12):1022-6.
Warren, R., et al., Assembling millions of short DNA sequences using SSAKE, Bioinformatics, 23:500-501 (2007).
Watson, et al., 2004, Cystic fibrosis population carrier screening: 2004 revision of American College of Medical Genetics mutation panel, Genetics in Medicine 6(5).
Williams , 2003, Restriction Endonucleases Classification, Properties, and Applications, Molecular Biotechnology 23(3):225-43.
Wittung, et al., 1997, Extended DNA-Recognition Repertoire of Peptide Nucleic Acid (PNA): PNA-dsDNA Triplex Formed with Cytosine-Rich Homopyrimidine PNA, Biochemistry 36:7973.
Wu & Aboleneed , 2001, Improved oligonucleotide sequencing by alkaline phosphatase and exonuclease digestions with mass spectrometry, Anal Biochem 290:347-352.
Wu, et al., 1998, Sequencing regular and labeled oligonucleotides using enzymatic digestion and ionspray mass spectrometry, Anal Biochem 263:129-138.
Yau, et al., 1996, Accurate diagnosis of carriers of deletions and duplications in Duchenne/Becker muscular dystrophy by fluorescent dosage analysis, Journal Medical Genetics 33(7):550-8.
Yoo, et al., 2009, Applications of DNA Microarray in Disease Diagnostics, Journal of Microbiology and Biotechnology 19(7):635-46.
Yoshida, et al., 2004, Role of BRCA1 and BRCA2 as regulators of DNA repair, transcription, and cell cycle in response to DNA damage, Cancer Science 95(11)866-71.
Yu, 2007, A Novel Set of DNA Methylation Markers in Urine Sediments for Sensitive/Specific Detection of Bladder Cancer, Clinical Cancer Research 13(24):7296-7304.
Yuan, Robert, 1981, Structure and Mechanism of Multifunctional Restriction Endonucleases Annuual Review of Biochemistry 50:285-319.
Zerbino D.R. et al., Velvet: algorithms for de novo short read assembly using de Bruijn graphs, Genome Research 18(5):821-829 (2008).
International Search Report and Written Opinion mailed Dec. 9, 2014, for International Patent Application No. PCT/US14/28212, filed Mar. 14, 2014 (11 pages).
Thiyagarajan, 2006, PathogenMIPer: a tool for the design of molecular inversion probes to detect multiple pathogens, BMC Bioinformatics, 7:500 (10 pages).
Alazard, et al., 2002, Sequencing of production-scale synthetic oligonucleotides by enriching for coupling failures using matrix-assisted laser desorption/ ionization time-of-flight mass spectrometry, Analytical biochemistry 301:57-64.
Albert, 2007, Direct selection of human genomic loci by microarray hybridization, Nature Methods 4(11):903-5.
Aljanabi, Salah M.; Martinez, Iciar, 1997, Universal and rapid salt-extraction of high quality genomic DNA for PCR-based techniques Nucl. Acids Res. 25:4692-3.

(56) References Cited

OTHER PUBLICATIONS

Antonarakis & the Nomenclature Working Group, 1998, Recommendations for a nomenclature system for human gene mutations, Human Mutation 11:1-3.
Barany, F, 1991, Genetic disease detection and DNA amplification using cloned thermostable ligase, PNAS, 88:189-193.
Barany, F, 1991, The Ligase Chain Reaction in a PCR World, Genome Research, 1:5-16.
Bentzley, et al., 1996, Oligonucleotide sequence and composition determined by matrix-assisted laser desorption/ionization, Anal Chem 68:2141-2146.
Bentzley, et al., 1998, Base specificity of oligonucleotide digestion by calf spleen phosphodiesterase with matrixassisted laser desorption ionization analysis, Anal Biochem 258:31-37.
Bickle, Thomas A. & Kruger, Detlev, H., 1993, Biology of DNA Restriction, Microbiological Reviews 57(2):434-50.
Boyer, H. W., 1971, DNA restriction and modification mechanisms in bacteria, Annual Review of Microbiology 25:153-76.
Braasch, et al., 2001, Locked nucleic acid (LNA): ¢ne-tuning the recognition of DNA and RNA, Chemistry & Biology 8(1): 1-7.
Braslavsky, et al., 2003, Sequence information can be obtained from single DNA molecules, Proceedings of the National Academy of Sciences, (USA) 100:3960-4.
Brown et al., Chemical synthesis and cloning of a tyrosine tRNA gene, Methods Enzymol., 68:109 (1979).
Browne, Kenneth A., 2002, Metal ion-catalyzed nucleic acid alkylation and fragmentation, Journal of American Chemical Society, 124(27)7950-62.
Bunyan, et al., 2004, Dosage analysis of cancer predisposition genes by multiplex ligation-dependent probe amplification, British Journal of Cancer, 91(6):1155-59.
Burrow & Wheeler, 1994, A block-sorting lossless data compression algorithm, Technical Report 124, Digital Equipment Corporation, CA.
Castellani, et al., 2008, Consensus on the use and interpretation of cystic fibrosis mutation analysis in clinical practice, Journal of Cystic Fibrosis 7(3):179-96.
Chan, et al., 2011, Natural and engineered nicking endonucleases from cleavage mechanism to engineering of strand-specificity, Nucleic Acids Research, 39(1):1-18.
Chevreux, B., et al., 1999, Genome Sequence Assembly Using Trace Signals and Additional Sequence Information, Computer Science and Biology: Proceedings of the German Conference on Bioinformatics (GCB) 99:45-56.
Chirgwin, et al., 1979, Isolation of biologically active ribonucleic acid from sources enriched in ribonuclease, Biochemistry, 18:5294-99.
Choe, et al., 2010, Novel CFTR Mutations in a Korean Infant with Cystic Fibrosis and Pancreatic Insufficiency, J Korean Med Sci 25:163-5.
Ciotti, et al., 2004, Triplet Repeat Primed PCR (TP PCR) in Molecular Diagnostic Testing for Friedrich Ataxia, Journal of Molecular Diagnostics 6(4):285-9.
Dahl, et al., 2005, Multiplexamplification enabled by selective circularization of large sets of genomic DNA fragments, Nucleic Acids Research 33:e71.
De la Bastide, M. & McCombie, 2007, W. R., Assembling genome DNA sequences with PHRAP, Current Protocols in Bioinformatics, 17:11.4.1-11.4.15.
Delcher, A.L., et al., 1999, Alignment of whole genomes, Nucleic Acids Research, 27:11.
Diguistini, S., et al., 2009, De novo genome sequence assembly of a filamentous fungus using Sanger, 454 and Illumina sequence data, Genome Biology, 10:R94.
Dong, C. & Yu, B., 2011, Mutation Surveyor: An In Silico Tool for Sequencing Analysis, Methods in Molecular Biology 760:223-37.
Dore, et al., 1969, The Alkaline Denaturation of Dna, Biophysical Journal 9(11):1281-1311.

Dudley, et al., 2009, A Quick Guide for Developing Effective Bioinformatics Programming Skills, PLOS Comput Biol 5(12):e1000589.
Exam Report from EPO for EP 10770071.8, dated Jul. 16, 2013.
Faulstich, et al., 1997, A sequencing method for RNA oligonucleotides based on mass spectrometry, Anal Chem 69:4349-4353.
Frey, Bruce, 2006, Statistics Hacks 108-115.
Friedenson, 2005, BRCA1 and BRCA2 Pathways and the Risk of Cancers Other Than Breast or Ovarian, Medscape General Medicine 7(2):60.
Gemayel, et al., 2010, Variable Tandem Repeats Accelerate Evolution of Coding and Regulatory Sequences, Annual Review of Genetics 44:445-77.
Glover, et al., 1995, Sequencing of oligonucleotides using high performance liquid chromatography and electrospray mass spectrometry, Rapid Com Mass Spec 9:897-901.
Gnirke, et al., 2009, Solution hybrid selection with ultra-long oligonucleotides for massively parallel targeted sequencing, nature biotechnology 27:182-9.
Goto, et al., 2010, BioRuby: bioinformatics software for the Ruby programming language, Bioinformatics 26(20):2617-9.
Gut, I. G. & Beck, S., 1995, A procedure for selective DNA alkylation and detection by mass spectrometry, Nucleic Acids Research 23(8):12367-73.
Hammond, et al., 1996, Extraction of DNA from Preserved Animal Specimens for Use in Randomly Amplified Polymorphic DNA Analysis, Analytical Biochemistry 240:298-300.
Hardenbol, et al., 2003, Multiplexed genotyping with sequence-tagged molecular inversion probes, nature biotechnology 21:673-8.
Harris, et al., 2008, Single-Molecule DNA Sequencing of a Viral Genome, Science 320:106-9.
Hodges, et al., 2007, Genome-wide in situ exon capture for selective resequencing, nature genetics 29:1522-7.
Holland, et al., 2008, BioJava: an open-source framework for bioinformatics, Bioinformatics 24(18):2096-97.
Huang, et al., 2008, Comparative analysis of common CFTRpolymorphisms poly-T, TGrepeats and M470V in a healthy Chinese population, World J Gastroenterol 14(12):1925-30.
International Preliminary Report on Patentability for PCT/US2010/01293.
International Search Report and Written Opinion for WO2010/126614.
International Search Report and Written Opinion mailed Apr. 3, 2012, for International Patent Application No. PCT/US2011/065098, filed Dec. 15, 2011 (8 pages).
International Search Report and Written Opinion mailed Aug. 12, 2013, for International Patent Application No. PCT/US13/36575, filed Apr. 15, 2013 (9 pages).
International Search Report and Written Opinion mailed Feb. 25, 2013 for International Patent Application No. PCT/US12/55362.
International Search Report and Written Opinion mailed Jun. 10, 2013, for International Patent Application No. PCT/US13/33435, filed Mar. 22, 2013 (6 pages).
Ericsson et al., 2008, "A dual-tag microarray platform for high-performance nucleic acid and protein analyses," Nucleic Acids Research 36:e45 (9 pages).
Zhang, et al., 2011, Is Mitochondrial RNAphe Variant m.593T.Ca Synergistically Pathogenic Mutation in Chinese LHON Families with m. 11778G.A? PLOS ONE 6(10):e26511.
Zhao F., et al., PGA4genomics for comparative genome assembly based on genetic algorithm optimization, Genomics. 94(4):284-6 (2009)); and.
Zheng, et al., iAssembler: a package for de novo assembly of Roche-454/Sanger transcriptome sequences, BMC Bioinformatics 12:453 (2011).
Zimmerman, et al., 2010, A novel custom resequencing array for dilated cardiomyopathy, Genetics in Medicine 12(5):268-78.
Smirnov, et al., 1996, Sequencing oligonucleotides by exonuclease digestion and delayed extraction matrix-assisted laser desorption ionization time-of-flight mass spectrometry, Anal Biochem 238(1):19-25.
Alazard, et al., 2005, Sequencing Oligonucleotides by Enrichment of Coupling Failures Using Matrix-Assisted Laser Desorption/

(56) References Cited

OTHER PUBLICATIONS

Ionization Time-of-Flight Mass Spectrometry, Current Protocols in Nucleic Acid Chemistry 10.10.1-10.10.7.
Husemann, P. & Stoye, 2009, Phylogenetic Comparative Assembly, Algorithms in Bioinformatics: 9th International Workshop, pp. 145-156, Salzberg, S., and Warnow, T., Eds. Springer-Verlag, Berlin Heidelberg.

\* cited by examiner

Upstream Snapshot
Homozygous G: -----
Heterozygous GT: ———/ ---

Downstream Snapshot
Homozygous C: ··· ··· ··· ···
Heterozygous CA: ———/··· ··· ···

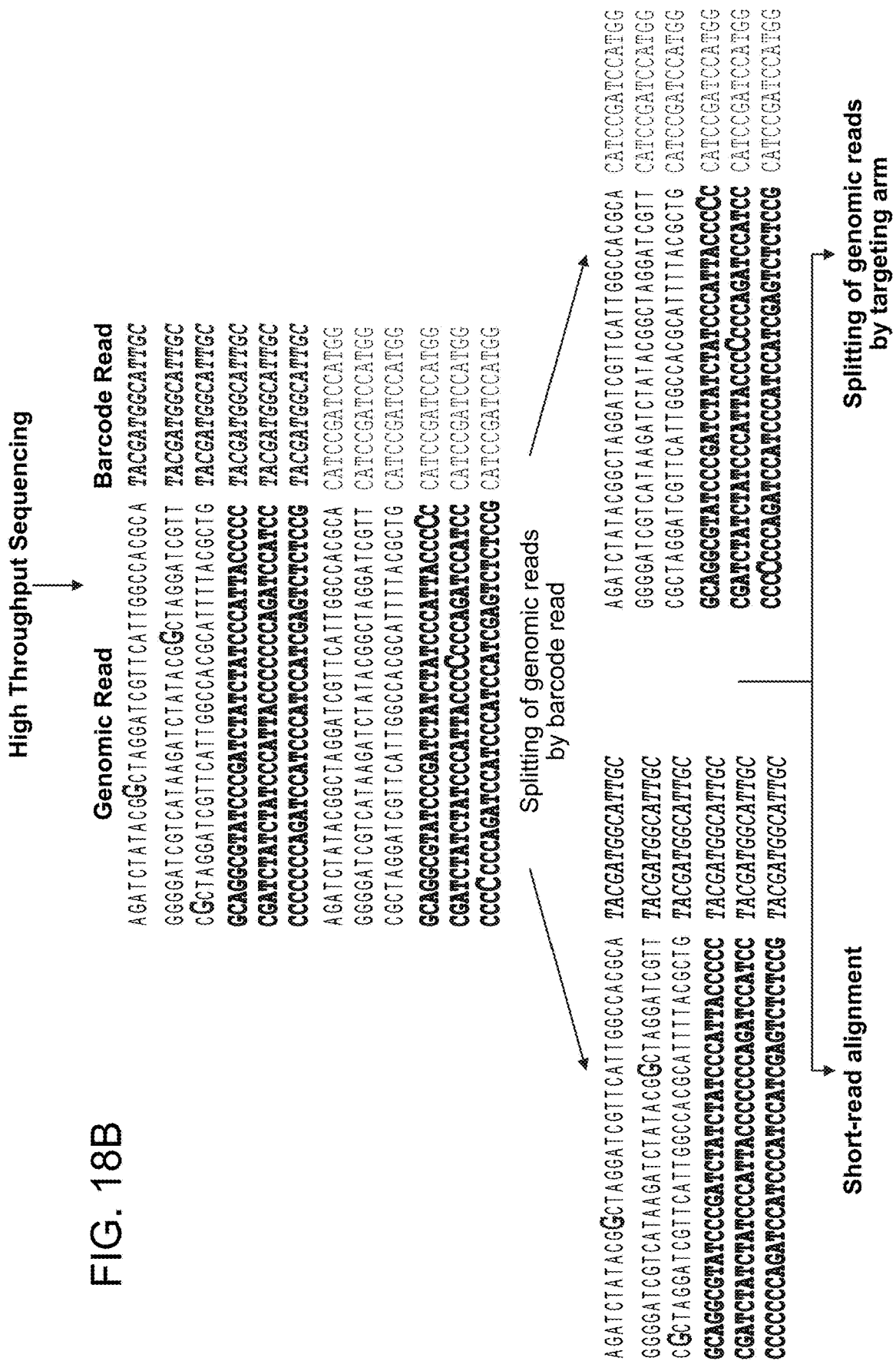

↓ Short-Read Alignment

```
cGCTAGGATCGTTCATTGGCCACGCATTTTACGCTG
| ||||||||||||||||||||||||||||||||||
GGGGATCGTCATAAGATCTATACCGTAGGATCGTTCATTGGCCACGCATTTTACGCTG
|||||||||||  ||||||||||||||||||||||||
         AGATCTATACGGCTAGGATCGTTCATTGGCCACGCA
```

```
CGATCTATCTATCCCATTACCCGCCCAGATCCATCC
||||||||||||||||||||||||||||||||||||
GCAGGCGTATCCCGATCTATCTATCCCATTACCCGCCCAGATCCATCCCATCCATCGAGTCTCTCCG
                        |||||||||||||||||||||||||||||||||
                        CCCCCCAGATCCATCCCATCCATCGAGTCTCTCCG
```

↓

BAM chr7 123 36M GCAGGCGTATCCCGATCTATCTATCCCATTACCCGC
chr7 135 36   CGATCTATCTATCCCATTACCCGCCCAGATCCATCC chr10  513  11=1M24=  AGATCTATACGGCTAGGATCGTTCATTGGCCACGCA

↓ Recalibration, realignment and genotyping

VCF chr7 157 G . 0/0 barcode= *TACGATGGCATTGC*
chr10 524 G C 0/1 barcode= *TACGATGGCATTGC*

FIG. 18C

① Assemble into contigs: 2 are found (180 bp)

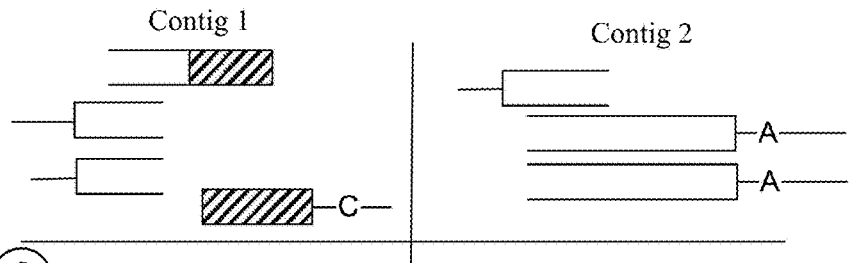

② Align contigs: both align to same reference position, but one contains a deletion and substitution, the other does not.

|  | Position | Cigar |
|---|---|---|
| Allele 1: | Chr 7: 11608523 | 180M |
| Allele 2: | Chr 7: 11608523 | 75M8D105M |

③ Align raw reads to contigs (raw reads are 80 bp)

| read 1 | Contig1:1 | 80M |
|---|---|---|
| read 2 | Contig2:1 | 80M |
| read 3 | Contig2:50 | 80M |
| read 4 | Contig2:100 | 80M |
| read 5 | Contig1:50 | 80M |
| ... | | |
| read 6 | Contig1:100 | 80M |

④ Map raw read alignments from contig space to original reference space (position & cigar)

| | CONTIG | | REFERENCE | |
|---|---|---|---|---|
| | Position | Cigar | Position | Cigar |
| read 1 | 1:1 | 80M | Chr7:11608523 | 85M |
| read 2 | 2:1 | 80M | Chr7:11608523 | 75M8D5M |
| read 3 | 2:50 | 80M | Chr7:11608573 | 25M8D55M |
| read 4 | 2:100 | 80M | Chr7:11608631 | 80M |
| read 5 | 1:50 | 80M | Chr7:11608573 | 80M |
| ... | | | | |
| read N | 1:100 | 80M | Chr7:11608623 | 80M |

⑤ Perform genotyping using translated, aligned reads from #4, including raw quality scores for substitutions

FIG. 24

METHODS AND COMPOSITIONS FOR EVALUATING GENETIC MARKERS

RELATED APPLICATIONS

The application claims the benefit of and priority to U.S. provisional application Ser. No. 61/789,164, filed Mar. 15, 2013, and is a continuation-in-part of U.S. application Ser. No. 13/266,862, which has a Section 371 (c) date of Mar. 13, 2012 and is a National Stage Entry of PCT application Ser. No. PCT/US10/01293, filed Apr. 30, 2010, which claims priority to and the benefit of U.S. provisional application Ser. No. 61/174,470, filed Apr. 30, 2009, U.S. provisional application Ser. No. 61/178,923, filed May 15, 2009, U.S. provisional application Ser. No. 61/179,358, filed May 18, 2009, and U.S. provisional application Ser. No. 61/182,089, filed May 28, 2009. The entire contents of each of these applications are incorporated to herein by reference.

SEQUENCE LISTING

The instant application contains a Sequence Listing which has been submitted in ASCII format via EFS-Web and is hereby incorporated by reference in its entirety. Said ASCII copy, created on Aug. 23, 2013, is named GSGE_002_03US_Sequence_Listing.txt and is 1,922,061 bytes in size.

FIELD OF INVENTION

The invention relates to methods and compositions for determining genotypes in patient samples.

BACKGROUND OF THE INVENTION

Information about the genotype of a subject is becoming more important and relevant for a range of healthcare decisions as the genetic basis for many diseases, disorders, and physiological characteristics is further elucidated. Medical advice is increasingly personalized, with individual decisions and recommendations being based on specific genetic information. Information about the type and number of alleles at one or more genetic loci impacts disease risk, prognosis, therapeutic options, and genetic counseling amongst other healthcare considerations.

For cost-effective and reliable medical and reproductive counseling on a large scale, it is important to be able correctly and unambiguously identify the allelic status for many different genetic loci in many subjects.

Numerous technologies have been developed for detecting and analyzing nucleic acid sequences from biological samples. These technologies can be used to genotype subjects and determine the allelic status of any locus of interest. However, they are not sufficiently robust and cost-effective to be scaled up for reliable high throughput analysis of many genetic loci in large numbers of patients. The frequency of incorrect or ambiguous calls is too high for current technology to manage large numbers of patient samples without involving expensive and time-consuming steps to resolve uncertainties and provide confidence in the information output.

SUMMARY OF THE INVENTION

Aspects of the invention relate to preparative and analytical methods and compositions for evaluating genotypes, and in particular, for determining the allelic identity (or identities in a diploid organism) of one or more genetic loci in a subject.

Aspects of the invention are based, in part, on the identification of different sources of ambiguity and error in genetic analyses, and, in part, on the identification of one or more approaches to avoid, reduce, recognize, and/or resolve these errors and ambiguities at different stages in a genetic analysis.

According to aspects of the invention, certain types of genetic information can be under-represented or over-represented in a genetic analysis due to a combination of stochastic variation and systematic bias in any of the preparative stages (e.g., capture, amplification, etc.), determining stages (e.g., allele-specific detection, sequencing, etc.), data interpretation stages (e.g., determining whether the assay information is sufficient to identify a subject as homozygous or heterozygous), and/or other stages.

According to aspects of the invention, error or ambiguity may be apparent in a genetic analysis, but not readily resolved without running additional samples or more expensive assays (e.g., array-based assays may report no-calls due to noisy/low signal). According to further aspects of the invention, error or ambiguity may not be accounted for in a genetic analysis and incorrect base calls may be made even when the evidence for them is limited and/or not statistically significant (e.g., next-generation sequencing technologies may report base calls even if the evidence for them is not statistically significant). According to further aspects of the invention error or ambiguity may be problematic for a multi-step genetic analysis because it is apparent but not readily resolved in one or more steps of the analysis and not apparent or accounted for in other steps of the analysis.

In some embodiments, sources of error and ambiguity in one or more steps can be addressed by capturing and/or interrogating each target locus of interest with one or more sets of overlapping probes that are designed to overcome any systematic bias or stochastic effects that may impact the complexity and/or fidelity of the genetic information that is generated.

In some embodiments, sources of error and ambiguity in one or more steps can be addressed by capturing and/or interrogating each target locus of interest with at least one set of probes, wherein different probes are labeled with different identifiers that can be used to track the assay reactions and determine whether certain types of genetic information are under-represented or over-represented in the information that is generated.

In some embodiments, errors and ambiguities associated with the analysis of regions containing large numbers of sequence repeats are addressed by systematically analyzing frequencies of certain nucleic acids at particular stages in an assay (e.g., at a to capture, sequencing, or detection stage). It should be appreciated that such techniques may be particularly useful in the context of a standardized protocol that is designed to allow many different loci to be evaluated in parallel without requiring different assay procedures for each locus. In some embodiments, the use of a single detection modality (e.g., sequencing) to assay multiple types of genetic lesions (e.g., point mutations, insertions/deletions, length polymorphisms) is advantageous in the clinical setting. In some embodiments of the invention, methods are provided that facilitate the use of multiple sample preparation steps in parallel, coupled with multiple analytical processes following sequence detection. Thus, in some embodiments of the invention, an improved workflow is provided that reduces error and uncertainty when simultaneously assaying different types of genetic lesions across multiple loci in multiple patients.

In some embodiments, aspects of the invention provide methods for overcoming preparative and/or analytical bias by combining two or more techniques, each having a different bias (e.g., a known bias towards under-representation or over-representation of one or more types of sequences), and using the resulting data to determine a genetic call for a subject with greater confidence.

It should be appreciated that in some embodiments, aspects of the invention relate to multiplex diagnostic methods. In some embodiments, multiplex diagnostic methods comprise capturing a plurality of genetic loci in parallel (e.g., one or more genetic loci from Table 1). In some embodiments, the genetic loci possess one or more polymorphisms (e.g., one or more polymorphisms from Table 2) the genotypes of which correspond to disease causing alleles.

Accordingly, in some embodiments, the disclosure provides methods for assessing multiple heritable disorders in parallel. In some embodiments, methods are provided for diagnosing multiple heritable disorders in parallel at a pre-implantation, prenatal, perinatal, or postnatal stage. In some embodiments, the disclosure provides methods for analyzing multiple genetic loci (e.g., a plurality of target nucleic acids selected from Table 1) from a patient sample, such as a blood, pre-implantation embryo, chorionic villus or amniotic fluid sample, or other sample (e.g., other biological fluid or tissue sample such as a biopsy sample) as aspects of the invention are not limited in this respect.

Other samples may include tumor tissue or circulating tumor cells. In some embodiments, a patient sample (e.g., a tumor tissue or cell sample) is mosaic for one or more mutations of interest, and thus, may require higher sensitivity than is needed for a germline mutation analysis. In some embodiments, a sample comprises cells from a non-host organism (e.g., bacterial or viral infections in a human subject) or a sample for environmental monitoring (e.g., bacterial, viral, fungal composition of a soil, water, or air sample).

Accordingly, in some embodiments, aspects of the methods disclosed herein relate to genotyping a polymorphism of a target nucleic acid. In some embodiments, the genotyping may comprise determining that one or more alleles of the target nucleic acid are heterozygous or homozygous. In further embodiments, the genotyping may comprise determining the sequence of a polymorphism and comparing that sequence to a control sequence that is indicative of a disease risk. In some embodiments, the polymorphism is selected from a locus in Table 1 or Table 2. However, it should be appreciated that any locus associated with a disease or condition of interest may be used.

In some embodiments, a diagnosis, prognosis, or disease risk assessment is provided to a subject based on a genotype determined for that subject at one or more genetic loci (e.g., based on the analysis of a biological sample obtained from that subject). In some embodiments, an assessment is provided to a couple, based on their respective genotypes at one or more genetic loci, of the risk of their having one or more children having a genotype associated with a disease or condition (e.g., a homozygous or heterozygous genotype associated with a disease or condition). In some embodiments, a subject or a couple may seek genetic or reproductive counseling in connection with a genotype determined according to embodiments of the invention. In some embodiments, genetic information from a tumor or circulating tumor cells is used to determine prognosis and guide selection of appropriate drugs/treatments.

It should be appreciated that any of the methods or compositions described herein may be used in combination with any of the medical evaluations associated with one or more genetic loci as described herein.

In some embodiments, aspects of the invention provide effective methods for overcoming challenges associated with systematic errors (bias) and/or stochastic effects in multiplex genomic capture and/or analysis (including sequencing analysis). In some embodiments, aspects of the invention are useful to avoid, reduce and/or account for variability in one or more sampling and/or analytical steps. For example, in some embodiments, variability in target nucleic acid representation and unequal sampling of heterozygous alleles in pools of captured target nucleic acids can be overcome.

Accordingly, in some embodiments, the disclosure provides methods that reduce variability in the detection of target nucleic acids in multiplex capture methods. In other embodiments, methods improve allelic representation in a capture pool and, thus, improve variant detection outcomes. In certain embodiments, the disclosure provides preparative methods for capturing target nucleic acids (e.g., genetic loci) that involve the use of different sets of multiple probes (e.g., molecular inversion probes MIPs) that capture overlapping regions of a target nucleic acid to achieve a more uniform representation of the target nucleic acids in a capture pool compared with methods of the prior art. In other embodiments, methods reduce bias, or the risk of bias, associated with large scale parallel capture of genetic loci, e.g., for diagnostic purposes. In other embodiments, methods are provided for increasing reproducibility (e.g., by reducing the effect of polymorphisms on target nucleic acid capture) in the detection of a plurality of genetic loci in parallel. In further embodiments, methods are provided for reducing the effect of probe synthesis and/or probe amplification variability on the analysis of a plurality of genetic loci in parallel.

According to some aspects, methods of analyzing a plurality of genetic loci are provided. In some embodiments, the methods comprise contacting each of a plurality of target nucleic acids with a probe set, wherein each probe set comprises a plurality of different probes, each probe having a central region flanked by a 5' region and a 3' region that are complementary to nucleic acids flanking the same strand of one of a plurality of subregions of the target nucleic acid, wherein the subregions of the target nucleic acid are different, and wherein each subregion overlaps with at least one other subregion, isolating a plurality of nucleic acids each having a nucleic acid sequence of a different subregion for each of the plurality of target nucleic acids, and analyzing the isolated nucleic acids.

In other embodiments, methods comprise contacting each of a plurality of target nucleic acids with a probe set, wherein each probe set comprises a plurality of different probes, each probe having a central region flanked by a 5' region and a 3' region that are complementary to nucleic acids flanking the same strand of one of a plurality of subregions of the target nucleic acid, wherein the subregions of the target nucleic acid are different, and wherein a portion of the 5' region and a portion of the 3' region of a probe have, respectively, the sequence of the 5' region and the sequence of the 3' region of a different probe, isolating a plurality of nucleic acids each having a nucleic acid sequence of a different subregion for each of the plurality of target nucleic acids, and analyzing the isolated nucleic acids.

In certain aspects, methods of the invention involve analyzing one or more genes with one or more molecular inversion probes provided in Appendix A. Particularly, those molecular inversion probes are used to capture various targets or subregions thereof on a gene selected from the group consisting of ABCC8, ASPA, BCKDHA, BCKDHB, BLM, CFTR, CLRN1, DLD, FANCC, G6PC, HEXA, IKBKAP, MCOLN1, PCDH15, and SMPD1. In certain applications, a set of two or more molecular inversion probes provided in Appendix A may be used to tile across different, but overlapping sub-regions of one or more genes so that one or more targets on the one or more genes are captured by at least two molecular inversion probes of the set. The number of molecular inversion probes used in a set for tile capture depends on the amount of overlapping coverage one desires for a certain target. In certain embodiments, a portion of one or more genes is captured using one or more molecular inversion probes in Appendix A. One or more molecular inversion probes of Appendix A may also be chosen to capture particular regions of interest, such as coding or noncoding regions, of a gene. In addition, one or more molecular inversion probes may be chosen to capture regions specific to certain diseases. The diseases may include, for example, Familial hyperinsulinism, Canavan disease, Maple syrup urine disease type 1*a*/1*b*, Bloom syndrome, Cystic fibrosis, Usher syndrome type IIIA, Dihydrolipoamide dehydrogenase deficiency, Fanconi anemia group C, Glycogen storage disease type 1*a*, Tay-Sachs disease, Familial dysautonomia, Mucolipidosis type IV, Usher syndrome type IF, Niemann-Pick disease type A/B.

Aspects of the disclosure are based, in part, on the discovery of methods for overcoming problems associated with systematic and random errors (bias) in genome capture, amplification and sequencing methods, namely high variability in the capture and amplification of nucleic acids and disproportionate representation of heterozygous alleles in sequencing libraries.

Accordingly, in some embodiments, the disclosure provides methods that reduce errors associated with the variability in the capture and amplification of nucleic acids. In other embodiments, the methods improve allelic representation in sequencing libraries and, thus, improve variant detection outcomes. In certain embodiments, the disclosure provides preparative methods for capturing target nucleic acids (e.g., genetic loci) that involve the use of differentiator tag sequences to uniquely tag individual nucleic acid molecules. In some embodiments, the differentiator tag sequence permit the detection of bias based on the occurrence of combinations of differentiator tag and target sequences observed in a sequencing reaction. In other embodiments, the methods reduce errors caused by bias, or the risk of bias, associated with the capture, amplification and sequencing of genetic loci, e.g., for diagnostic purposes.

Aspects of the invention relate to providing sequence tags (referred to as differentiator tags) that are useful to determine whether target nucleic acid sequences identified in an assay are from independently isolated target nucleic acids or from multiple copies of the same target nucleic acid molecule (e.g., due to bias in a preparative step, for example, amplification). This information can be used to help analyze a threshold number of independently isolated target nucleic acids from a biological sample in order to obtain sequence information that is reliable and can be used to make a genotype conclusion (e.g., call) with a desired degree of confidence. This information also can be used to detect bias in one or more nucleic acid preparative steps.

In some embodiments, the methods disclosed herein are useful for any application where reduction of bias, e.g., associated with genomic isolation, amplification, sequencing, is important. For example, detection of cancer mutations in a heterogeneous tissue sample, detection of mutations in maternally-circulating fetal DNA, and detection of mutations in cells isolated during a preimplantation genetic diagnostic procedure.

Accordingly, in some aspects, methods of genotyping a subject are provided. In some embodiments, the methods comprise determining the sequence of at least a threshold number of independently isolated nucleic acids, wherein the sequence of each isolated nucleic acid comprises a target nucleic acid sequence and a differentiator tag sequence, wherein the threshold number is a number of unique combinations of target nucleic acid and differentiator tag sequences, wherein the isolated nucleic acids are identified as independently isolated if they comprise unique combinations of target nucleic acid and differentiator tag sequences, and wherein the target nucleic acid sequence is the sequence of a genomic locus of a subject.

In some embodiments, the isolated nucleic acids are products of a circularization selection-based preparative method, e.g., molecular inversion probe capture products. In other embodiments, the isolated nucleic acids are products of an amplification-based preparative methods. In other embodiments, the isolated nucleic acids are products of hybridization-based preparative methods.

Circularization selection-based preparative methods selectively convert regions of interest (target nucleic acids) into a covalently-closed circular molecule which is then isolated typically by removal (usually enzymatic, e.g. with exonuclease) of any non-circularized linear nucleic acid. Oligonucleotide probes (e.g., molecular inversion probes) are designed which have ends that flank the region of interest (target nucleic acid) and, optionally, primer sites, e.g., sequencing primer sites. The probes are allowed to hybridize to the genomic target, and enzymes are used to first (optionally) fill in any gap between probe ends and second ligate the probe closed. Following circularization, any remaining (non-target) linear nucleic acid is typically removed, resulting in isolation (capture) of target nucleic acid. Circularization selection-based preparative methods include molecular inversion probe capture reactions and 'selector' capture reactions. In some embodiments, molecular inversion probe capture of a target nucleic acid is indicative of the presence of a polymorphism in the target nucleic acid.

In amplification-based (e.g., PCR-based or LCR-based, etc.) preparative methods, genomic loci (target nucleic acids) are isolated directly by means of a polymerase chain reaction or ligase chain reaction (or other amplification method) that selectively amplifies each locus using one or more oligonucleotide primers. It is to be understood that primers will be sufficiently complementary to the target sequence to hybridize with and prime amplification of the target nucleic acid. Any one of a variety of art known methods may be utilized for primer design and synthesis. One or more of the primers may be perfectly complementary to the target sequence. Degenerate primers may also be used. Primers may also include additional nucleic acids that are not complementary to target sequences but that facilitate downstream applications, including for example restriction sites and differentiator tag sequences. Amplification-based methods include amplification of a single target nucleic acid and multiplex amplification (amplification of multiple target nucleic acids in parallel).

Hybridization-based preparative methods involve selectively immobilizing target nucleic acids for further manipulation. It is to be understood that one or more oligonucleotides (immobilization oligonucleotides), which comprise differentiator tag sequences, and which may be from 15 to 170 nucleotides in length, are used which hybridize along the length of a target region of a genetic locus to immobilize it. In some embodiments, immobilization oligonucleotides, are either immobilized before hybridization is performed (e.g., Roche/Nimblegen 'sequence capture'), or are prepared such that they include a moiety (e.g. biotin) which can be used to selectively immobilize the target nucleic acid after hybridization by binding to e.g., streptavidin-coated microbeads (e.g. Agilent 'SureSelect').

It should be appreciated that any of the circularization, amplification, and/or hybridization based methods described herein may be used in connection with one or more of the tiling/staggering, tagging, size-detection, and/or sensitivity enhancing algorithms described herein.

In some embodiments, the methods disclosed herein comprise determining the sequence of molecular inversion probe capture products, each comprising a molecular inversion probe and a target nucleic acid, wherein the sequence of the molecular inversion probe comprises a differentiator tag sequence and, optionally, a primer sequence, and wherein the target nucleic acid is a captured genomic locus of a subject, and genotyping the subject at the captured genomic locus based on the sequence of at least a threshold number of unique combinations of target nucleic acid and differentiator tag sequences of molecular inversion probe capture products.

In some embodiments, the methods disclosed herein comprise obtaining molecular inversion probe capture products, each comprising a molecular inversion probe and a target nucleic acid, wherein the sequence of the molecular inversion probe comprises a differentiator tag sequence and, optionally, a primer sequence, wherein the target nucleic acid is a captured genomic locus of the subject, amplifying the molecular inversion probe capture products, and genotyping the subject by determining, for each target nucleic acid, the sequence of at least a threshold number of unique combinations of target nucleic acid and differentiator tag sequence of molecular inversion probe capture products. In certain embodiments, obtaining comprises capturing target nucleic acids from a genomic sample of the subject with molecular inversion probes, each comprising a unique differentiator tag sequence. In specific embodiments, capturing is performed under conditions wherein the likelihood of obtaining two or more molecular inversion probe capture products with identical combinations of target and differentiator tag sequences is equal to or less than a predetermined value, optionally wherein the predetermined value is about 0.05.

In one embodiment, the threshold number for a specific target nucleic acid sequence is selected based on a desired statistical confidence for the genotype. In some embodiments, the methods further comprising determining a statistical confidence for the genotype based on the number of unique combinations of target nucleic acid and differentiator tag sequences.

According to some aspects, methods of analyzing a plurality of genetic loci are provided. In some embodiments, the methods comprise obtaining a plurality of molecular inversion probe capture products each comprising a molecular inversion probe and a target nucleic acid, wherein the sequence of the molecular inversion probe comprises a differentiator tag sequence and, optionally, a primer sequence (e.g., a sequence that is complementary to the sequence of a nucleic acid that is used as a primer for sequencing or other extension reaction), amplifying the plurality of molecular inversion probe capture products, determining numbers of occurrence of combinations of target nucleic acid and differentiator tag sequence of molecular inversion probe capture products in the amplified plurality, and if the number of occurrence of a specific combination of target nucleic acid sequence and differentiator tag sequence exceeds a predetermined value, detecting bias in the amplification of the molecular inversion probe comprising the specific combination. In some embodiments, the methods further comprise genotyping target sequences in the plurality, wherein the genotyping comprises correcting for bias, if detected.

In some embodiments, the target nucleic acid is a gene (or portion thereof) selected from Table 1. In some embodiments, the genotyping comprises determining the sequence of a target nucleic acid (e.g., a polymorphic sequence) at one or more (both) alleles of a genome (a diploid genome) of a subject. In certain embodiments, the genotyping comprises determining the sequence of a target nucleic acid at both alleles of a diploid genome of a subject, wherein in the target nucleic acid comprises, or consists of, a sequence of Table 1, Table 2, or other locus of interest.

In some embodiments, aspects of the invention provide methods and compositions for identifying nucleic acid insertions or deletions in genomic regions of interest without determining the nucleotide sequences of these regions. Aspects of the invention are particularly useful for detecting nucleic acid insertions or deletions in genomic regions containing nucleic acid sequence repeats (e.g., di- or tri-nucleotide repeats). However, the invention is not limited to analyzing nucleic acid repeats and may be used to detect insertions or deletions in any target nucleic acid of interest. Aspects of the invention are particularly useful for analyzing multiple loci in a multiplex assay.

In some embodiments, aspects of the invention relate to determining whether an amount of target nucleic acid that is captured in a genomic capture assay is higher or lower than expected. In some embodiments, a statistically significant deviation from an expected amount (e.g., higher or lower) is indicative of the presence of a nucleic acid insertion or deletion in the genomic region of interest. In some embodiments, the amount is a number of nucleic acid molecules that are captured. In some embodiments, the amount is a number of independently captured nucleic acid molecules in a sample. It should be appreciated that the captured nucleic acids may be literally captured from a sample, or their sequences may be captured without actually capturing the original nucleic acids in the sample. For example, nucleic acid sequences may be captured in an assay that involves a template-based extension of nucleic acids having the region of interest, in the sample.

Aspects of the invention are based on the recognition that the efficiency of certain capture techniques is affected by the length of the nucleic acid being captured. Accordingly, an increase or decrease in the length of a target nucleic acid (e.g., due to an insertion or deletion of a repeated sequence) can alter the capture efficiency of that nucleic acid. In some embodiments, a difference in the capture efficiency (e.g., a statistically significant difference in the capture efficiency) of a target nucleic acid is indicative of an insertion or deletion in the target nucleic acid. It should be appreciated that the capture efficiency for a target nucleic acid may be evaluated based on an amount of captured nucleic acid (e.g., number of captured nucleic acid molecules) relative to a control amount (e.g., based on an amount of control nucleic acid that is captured). However, the invention is not limited in this respect and other techniques for evaluating capture efficiency also may be used.

According to aspects of the invention, evaluating the capture efficiency as opposed to determining the sequence of the entire repeat region reduces errors associated with sequencing through repeat regions. Repeat sequences often give rise to stutters or skips in sequencing reactions that make it very difficult to accurately determine the number of repeats in a target region without running multiple sequencing reactions under different conditions and carefully analyzing the results. Such procedures are cumbersome and not readily scalable in a manner that is consistent with high throughput analyses of target nucleic acids. In some embodiments, repeat regions may be longer than the length of the individual sequence read, making length determination on the basis of a single read impossible. For example, when using next-generation sequencing the repeat regions may be longer than the length of the individual sequence read, making length determination on the basis of a single read impossible. Accordingly, aspects of the invention are useful to increase the sensitivity of detecting insertions or deletions in target regions, particularly target regions containing repeated sequences.

In some embodiments, aspects of the invention relate to capturing genomic nucleic acid sequences using a molecular inversion probe (e.g., MIP or Padlock probe) technique, and determining whether the amount (e.g., number) of captured sequences is higher or lower than expected. In some embodiments, the amount (e.g., number) of captured sequences is compared to an amount (e.g., number) of sequences captured in a control assay. The control assay may involve analyzing a control sample that contains a nucleic acid from the same genetic locus having a known sequence length (e.g., a known number of nucleic acid repeats). However, a control may involve analyzing a second (e.g., different) genetic locus that is not expected to contain any insertions or deletions. The second genetic locus may be analyzed in the same sample as the locus being interrogated or in a different sample where its length has been previously determined. The second genetic locus may be a locus that is not characterized by the presence of nucleic acid repeats (and thus not expected to contain insertions or deletions of the repeat sequence).

In some embodiments, a target nucleic acid region that is being evaluated may be determined by the identity of the targeting arms of a probe that is designed to capture the target region (or sequence thereof). For example, the targeting arms of a MIP probe may be designed to be complementary (e.g., sufficiently complementary for selective hybridization and/or polymerase extension and/or ligation) to genomic regions flanking a target region suspected of containing an insertion or deletion. It should be appreciated that two targeting arms may be designed to be complementary (e.g., sufficiently complementary for selective hybridization and/or polymerase extension and/or ligation) to the two flanking regions that are immediately adjacent (e.g., immediately 5' and 3', respectively) to a region of a sequence repeat on one strand of a genomic nucleic acid. However, one or both targeting arms may be designed to hybridize several bases (e.g., 1-5, 5-10, 10-25, 25-50, or more) upstream or downstream from the repeat region in such a way that the captured sequence includes a region of unique genomic sequence that on one or both sides of the repeat region. This unique region can then be used to identify the captured target (e.g., based on sequence or hybridization information).

In some embodiments, two or more (e.g., 2, 3, 4, 5, 6, 7, 8, 9, 10 or more) different loci may be interrogated in parallel in a single assay (e.g., in a multiplex assay). In some embodiments, the ratio of captured nucleic acids for each locus may be used to determine whether a nucleic acid insertion or deletion is present in one locus relative to the other. For example, the ratio may be compared to a control ratio that is representative of the two loci when neither one has an insertion or deletion relative to control sequences (e.g., sequences that are normal or known to be associated with healthy phenotypes for those loci). However, the amount of captured nucleic acids may be compared to any suitable control as discussed herein.

The locus of a captured sequence may be identified by determining a portion of unique sequence 5' and/or 3' to the repeat region in the target nucleic acid suspected of containing a deletion or insertion. This does not require sequencing the captured repeat region itself. However, some or all of the repeat region also could be sequenced as aspects of the invention are not limited in this respect.

Aspects of the invention may be combined with one or more sequence-based assays (e.g., SNP detection assays), for example in a multiplex format, to determine the genotype of one or more regions of a subject.

In some embodiments, methods of detecting a polymorphism in a nucleic acid in a biological sample are provided. In some embodiments, the methods comprise evaluating the efficiency of capture at one or more loci and determining whether one or both alleles at that locus contain an insertion or deletion relative to a control locus (e.g., a locus indicative of a length of repeat sequence that is associated with a healthy phenotype).

Accordingly, aspects of the invention relate to methods for determining whether a target nucleic acid has an abnormal length by evaluating the capture efficiency of a target nucleic acid in a biological sample from a subject, wherein a capture efficiency that is different from a reference capture efficiency is indicative of the presence, in the biological sample, of a target nucleic acid having an abnormal length. It should be appreciated that the term "abnormal" is a relative term based on a comparison to a "normal" length. In some embodiments, a normal length is a length that is associated with a normal (e.g., healthy or non-carrier phenotype).

Accordingly, an abnormal length is a length that is either shorter or longer than the normal length. In some embodiments, the presence of an abnormal length is indicative of an increased risk that the locus is associated with a disease or a disease carrier phenotype. In some embodiments, the abnormal length is indicative that the subject is either has a disease or condition or is a carrier of a disease or condition (e.g., associated with the locus). However, it should be appreciated that the description of embodiments relating to detecting the presence of an abnormal length also support detecting the presence of a length that is different from an expected or control length.

In some embodiments, aspects of the invention relate to estimating the length of a target nucleic acid (e.g., of a sub-target region within a target nucleic acid). In some embodiments, aspects of the invention relate to methods for estimating the length of a target nucleic acid by contacting the target nucleic acid with a plurality of detection probes under conditions that permit hybridization of the detection probes to the target nucleic acid, wherein each detection probe is a polynucleotide that comprises a first arm that hybridizes to a first region of the target nucleic acid and a second arm that hybridizes to a second region of the target nucleic acid, wherein the first and second regions are on a common strand of the target nucleic acid, and wherein the nucleotide sequence of the target between the 5' end of the first region and the 3' end of the second region is the nucleotide sequence of a sub-target nucleic acid; and capturing a plurality of sub-target nucleic acids that are hybridized with the plurality of detection probes; and measuring the frequency of occurrence of a sub-target nucleic acid in the plurality of sub-target nucleic acids, wherein the frequency of occurrence of the sub-target nucleic acid in the plurality of sub-target nucleic acids is indicative of the length of the sub-target nucleic acid. It should be appreciated that methods for estimating a nucleic acid length may involve comparing a capture efficiency for a target nucleic acid region to two or more reference efficiencies for known nucleic acid lengths in order to determine whether the target nucleic acid region is smaller, intermediate, or larger in size than the known control lengths. In some embodiments, a series of nucleic acids of known different lengths may be used to provide a calibration curve for evaluating the length of a target nucleic acid region of interest.

In some embodiments, the capture efficiency of a target region suspected of having a deletion or insertion is determined by comparing the capture efficiency to a reference indicative of a normal capture efficiency. In some embodiments, the capture efficiency is lower than the reference capture efficiency. In some embodiments, the subject is identified as having an insertion in the target region. In some embodiments, the capture efficiency is higher than the reference capture efficiency. In some embodiments, the subject is identified as having a deletion in the target region. In some embodiments, the subject is identified as being heterozygous for the insertion. In some embodiments, the subject is identified as being heterozygous for the deletion.

In some embodiments of any of the methods described herein (e.g., tiling/staggering, tagging, size-detection, and/or sensitivity enhancement) aspects of the invention relate to capturing a sub-target nucleic acid (or a sequence of a sub-target nucleic acid). In some embodiments, a molecular inversion probe technique is used. In some embodiments, a molecular inversion probe is a single linear strand of nucleic acid that comprises a first targeting arm at its 5' end and a second targeting arm at its 3' end, wherein the first targeting arm is capable of specifically hybridizing to a first region flanking one end of the sub-target nucleic acid, and wherein the second targeting arm is capable of specifically hybridizing to a second region flanking the other end of the sub-target nucleic acid on the same strand of the target nucleic acid. In some embodiments, the first and second targeting arms are between about 10 and about 100 nucleotides long. In some embodiments, the first and second targeting arms are about 10-20, 20-30, 30-40, or 40-50 nucleotides long. In some embodiments, the first and second targeting arms are about 20 nucleotides long. In some embodiments, the first and second targeting arms have the same length. In some embodiments, the first and second targeting arms have different lengths. In some embodiments, each pair of first and second targeting arms in a set of probes has the same length. Accordingly, if one of the targeting arms is longer, the other one is correspondingly shorter. This allows for a quality control step in some embodiments to confirm that all captured probe/target sequence products have the same length after a multiplexed plurality of capture reactions. In some embodiments, a set of probes may be designed to have the same length if the intervening region is varied to accommodate any differences in the length of either one or both of the first and second targeting arms.

In some embodiments, the hybridization Tms of the first and second targeting arms are similar. In some embodiments, the hybridization Tms of the first and second targeting arms are within 2-5° C. of each other. In some embodiments, the hybridization Tms of the first and second targeting arms are identical. In some embodiments, the hybridization Tms of the first and second targeting arms are close to empirically-determined optima but not necessarily identical.

In some embodiments, the first and second targeting arms of a molecular inversion probe have different Tms. For example, the Tm of the first targeting arm (at the 5' end of the molecular inversion probe) may be higher than the Tm of the second targeting arm (at the 3' end of the molecular inversion probe). According to aspects of the invention, and without wishing to be bound by theory, a relatively high Tm for the first targeting arm may help avoid or prevent the first targeting arm from being displaced after hybridization by the extension product of the 3' end of the second targeting arm. It should be appreciated that a reference to the Tm of a targeting arm as used herein relates to the Tm of hybridization of the targeting arm to a nucleic acid having the complementary sequence (e.g., the region of the target nucleic acid that has a sequence that is complementary to the sequence of the targeting arm). It also should be appreciated that the Tms of the targeting arms described herein may be calculated using any appropriate method. For example, in some embodiments an experimental method (e.g., a gel shift assay, a hybridization assay, a melting curve analysis, for example in a PCR machine with a SYBR dye by stepping through a temperature ramp while monitoring signal level from an intercalating dye, for example, bound to a double-stranded DNA, etc.) may be used to determine one or more Tms empirically. In some embodiments, an optimal Tm may be determined by evaluating the number of products formed (e.g., for each of a plurality of MIP probes), and determining the optimal Tm as the center point in a histogram of Tm for all targeting arms. In some embodiments, a predictive algorithm may be used to determine a Tm theoretically. In some embodiments, a relatively simple predictive algorithm may be used based on the number of G/C and A/T base pairs when the sequence is hybridized to its target and/or the length of the hybridized product (e.g., for example, $64.9+41*([G+C]-16.4)/(A+T+G+C)$, see for example, Wallace, R. B., Shaffer, J., Murphy, R. F., Bonner, J., Hirose, T., and Itakura, K. (1979) Nucleic Acids Res 6:3543-3557). In some embodiments, a more complex algorithm may be used to account for the effects of base stacking entropy and enthalpy, ion concentration, and primer concentration (see, for example, SantaLucia J (1998), Proc Natl Acad Sci USA, 95:1460-5). In some embodiments an algorithm may use modified parameters (e.g., nearest-neighbor parameters for basepair entropy/enthalpy values). It should be appreciated that any suitable algorithm may be used as aspects of the invention are not limited in this respect. However, it also should be appreciated that different methodologies may results in different calculated or predicted Tms for the same sequences. Accordingly, in some embodiments, the same empirical and/or theoretical method is used to determine the Tms of different sequences for a set of probes to avoid a negative impact of any systematic difference in the Tm determination or prediction when designing a set of probes with predetermined similarities or differences for different Tms.

In some embodiments, the Tm of the first targeting arm may be about 1° C., about 2° C., about 3° C., about 4° C., about 5° C., or more than about 5° C. higher than the Tm of the second targeting arm. In some embodiments, each probe in a plurality of probes (e.g., each probe in a set of 5-10, each probe in a set of at least 10, each probe in a set of 10-50, each probe in a set of 50-100, each probe in a set of 100-500, each probe in a set of 500-1,000, each probe in a set of 1,000-1,500, each probe in a set of 1,500-2,000, each probe in a set of 2,000-3,000, 3,000-5,000, 5,000-10,000 or each probe in a set of at least 5,000 different probes) has a unique first targeting arm (e.g., they all have different sequences) and a unique second targeting arm (e.g., they all have different sequences). In some embodiments, for at least 10% of the probes (e.g., at least 25%, 25%-50%, 50%-75%, 75%-90%, 90%-95% or over 95%, or all of the probes) the first targeting arm has a Tm for its complementary sequence that is higher (e.g., about 1° C., about 2° C., about 3° C., about 4° C., about 5° C., or more than about 5° C. higher) than the Tm of the second targeting arm for its complementary sequence. In some embodiments, each of the first targeting arms have similar or identical Tms for their respective complementary sequences and each of the second targeting arms have similar or identical Tms for their respective complementary sequences (and the first targeting arms have higher Tms than the second targeting arms). For example, in some embodiments, the Tm of the first arm(s) may be about 58° C. and the Tm of the second arm(s) may be about 56° C. In some embodiments, the Tm of the first arm(s) may be about 68° C., and the Tm of the second arm(s) may be about 65° C. It should be appreciated that in some embodiments the similarity (e.g., within a range of 1° C., 2° C., 3° C., 4° C., 5° C.) or identity of the Tms for the different targeting arms should be based either on empirical data for each arm or based on the same predictive algorithm for each arm (e.g., Wallace, R. B., Shaffer, J., Murphy, R. F., Bonner, J., Hirose, T., and Itakura, K. (1979) Nucleic Acids Res 6:3543-3557, SantaLucia J (1998), Proc Natl Acad Sci USA, 95:1460-5, or other algorithm).

In some embodiments, the Tm of the first targeting arm of a molecular inversion probe (at the 5' end of the molecular inversion probe) is selected to be sufficiently stable to prevent displacement of the first targeting arm from its complementary sequence on a target nucleic acid. In some embodiments, the Tm of the first targeting arm is 50-55° C., at least 55° C., 55-60° C., at least 60° C., 60-65° C., at least 65° C., at least 70° C., at least 75° C., or at least 80° C. As discussed above, it should be appreciated that the for a particular targeting arm may be determined empirically or theoretically. Different theoretical models may be used to determine a Tm and it should be appreciated that the predicted Tm for a particular sequence may be different depending on the algorithm used for the prediction. In some embodiments, each probe in a plurality of probes (e.g., each probe in a set of 5-10, each probe in a set of at least 10, each probe in a set of 10-50, each probe in a set of 50-100, each probe in a set of 100-500, or each probe in a set of at least 500 different probes) has a different first targeting arm (e.g., different sequences) but each different first targeting arm has a similar or identical Tm for its complementary sequence on a target nucleic acid. It should be appreciated that in some embodiments the similarity (e.g., within a range of 1 C, 2 C, 3 C, 4 C, 5 C) or identity of the Tms for the different targeting arms should be based either on empirical data for each arm or based on the same predictive algorithm for each arm (e.g., Wallace, R. B., Shaffer, J., Murphy, R. F., Bonner, J., Hirose, T., and Itakura, K. (1979) Nucleic Acids Res 6:3543-3557, SantaLucia J (1998), Proc Natl Acad Sci USA, 95:1460-5, or other algorithm).

In some embodiments, the sub-target nucleic acid contains a nucleic acid repeat. In some embodiments, the nucleic acid repeat is a dinucleotide or trinucleotide repeat. In some embodiments, the sub-target nucleic acid contains 10-100 copies of the nucleic acid repeat in the absence of an abnormal increase or decrease in nucleic acid repeats. In some embodiments, the sub-target nucleic acid is a region of the Fragile-X locus that contains a nucleic acid repeat. In some embodiments, one or both targeting arms hybridize to a region on the target nucleic acid that is immediately adjacent to a region of nucleic acid repeats. In some embodiments, one or both targeting arms hybridize to a region on the target nucleic acid that is separated from a region of nucleic acid repeats by a region that does not contain any nucleic acid repeats. In some embodiments, the molecular inversion probe further comprises a primer-binding region that can be used to sequence the captured sub-target nucleic acid and optionally the first and/or second targeting arm.

In some embodiments, aspects of the invention relate to evaluating the length of a plurality of different target nucleic acids in a biological sample. In some embodiments, the plurality of target nucleic acids are analyzed using a plurality of different molecular inversion probes. In some embodiments, each different molecular inversion probe comprises a different pair of first and second targeting arms at each of the 3' and 5' ends. In some embodiments, each different molecular inversion probe comprises the same primer-binding sequence.

In some embodiments, aspects of the invention relate to analyzing nucleic acid from a biological sample obtained from a subject. In some embodiments, the biological sample is a blood sample. In some embodiments, the biological sample is a tissue sample, specific cell population, tumor sample, circulating tumor cells, or environmental sample. In some embodiments, the biological sample is a single cell. In some embodiments, nucleic acids are analyzed in biological samples obtained from a plurality of different subjects. In some embodiments, nucleic acids from a biological sample are analyzed in multiplex reactions. It should be appreciated that a biological sample contains a plurality of copies of a genome derived from a plurality of cells in the sample. Accordingly, a sample may contain a plurality of independent copies of a target nucleic acid region of interest, the capture efficiency of which can be used to evaluate its size as described herein.

In some embodiments, aspects of the invention relate to evaluating a nucleic acid capture efficiency by determining an amount of target nucleic acid that is captured (e.g., an amount of sub-target nucleic acid sequences that are captured). In some embodiments, the amount of target nucleic acid that is captured is determined by determining a number of independently captured target nucleic acid molecules (e.g., the amount of independently captured molecules that have the sequence of the sub-target region). In some embodiments, the amount of target nucleic acid that is captured is compared to a reference amount of captured nucleic acid. In some embodiments, the reference amount is determined by determining a number of independently captured molecules of a reference nucleic acid. In some embodiments, the reference nucleic acid is a nucleic acid of a different locus in the biological sample that is not suspected of containing a deletion or insertion. In some embodiments, the reference nucleic acid is a nucleic acid of known size and amount that is added to the capture reaction. As described herein, a number of independently captured nucleic acid sequences can be determined by contacting a nucleic acid sample with a preparation of a probe (e.g., a MIP probe as described herein). It should be appreciated that the preparation may comprise a plurality of copies of the same probe and accordingly a plurality of independent copies of the target region may be captured by different probe molecules. The number of probe molecules that actually capture a sequence can be evaluated by determining an amount or number of captured molecules using any suitable technique. This number is a reflection of both the number of target molecules in the sample and the efficiency of capture of those target molecules, which in turn is related to the size of the target molecules as described herein. Accordingly, the capture efficiency can be evaluated by controlling for the abundance of the target nucleic acid, for example by comparing the number or amount of captured target molecules to an appropriate control (e.g., a known size and amount of control nucleic acid, or a different locus that should be present in the same amount in the biological sample and is not expected to contain any insertions or deletions). It should be appreciated that other factors may affect the capture efficiency of a particular target nucleic acid region (e.g., the sequence of the region, the GC content, the presence of secondary structures, etc.). However, these factors may also can be accounted for by using appropriate controls (e.g., known sequences having similar properties, the same sequences, other genomic sequences expected to be present in the biological sample at the same frequency, etc., or any combination thereof).

In some embodiments, aspects of the invention relate to identifying a subject as having an insertion or deletion in one or more alleles of a genetic locus if the capture efficiency for that genetic locus is statistically significantly different than a reference capture efficiency. It should be appreciated that hybridization conditions used for any of the capture techniques described herein (e.g., MIP capture techniques) can be based on known hybridization buffers and conditions.

In some embodiments, the methods disclosed herein are useful for any application where the detection of deletions or insertions is important.

In some embodiments, aspects of the invention relate to basing a nucleic acid sequence analysis on results from two or more different nucleic acid preparatory techniques that have different systematic biases in the types of nucleic acids that they sample. According to the invention, different techniques have different sequence biases that are systematic and not simply due to stochastic effects during nucleic acid capture or amplification. Accordingly, the degree of oversampling required to overcome variations in nucleic acid preparation needs to be sufficient to overcome the biases (e.g., an oversampling of 2-5 fold, 5-10 fold, 5-15 fold, 15-20 fold, 20-30 fold, 30-50 fold, or intermediate to higher fold).

According to some embodiments, different techniques have different characteristic or systematic biases. For example, one technique may bias a sample analysis towards one particular allele at a genetic locus of interest, whereas a different technique would bias the sample analysis towards a different allele at the same locus. Accordingly, the same sample may be identified as being different depending on the type of technique that is used to prepare nucleic acid for sequence analysis. This effectively represents a sensitivity limitation, because each technique has different relative sensitivities for polymorphic sequences of interest.

According to aspects of the invention, the sensitivity of a nucleic acid analysis can be increased by combining the sequences from different nucleic acid preparative steps and using the combined sequence information for a diagnostic assay (e.g., for a making a call as to whether a subject is homozygous or heterozygous at a genetic locus of interest).

In some embodiments, the invention provides a method of increasing the sensitivity of a nucleic acid detection assay by obtaining a first preparation of a target to nucleic acid using a first preparative method on a biological sample, obtaining a second preparation of a target nucleic acid using a second preparative method on the biological sample, assaying the sequences obtained in both first and second nucleic acid preparations, and using the sequence information from both first and second nucleic acid preparations to determine the genotype of the target nucleic acid in the biological sample, wherein the first and second preparative methods have different systematic sequence biases. In some embodiments, the first and second nucleic acid preparations are combined prior to performing a sequence assay. In some embodiments, separate sequence assays are performed on the first and second nucleic acid preparations and the sequence information from both assays are combined to determine the genotype of the target nucleic acid in the biological sample. In some embodiments, the first preparative method is an amplification-based, a hybridization-based, or a circular probe-based preparative method. In some embodiments, the second method is an amplification-based, a hybridization-based, or a circular probe-based preparative method. In some embodiments, the first and second methods are of different types (e.g., only one of them is an amplification-based, a hybridization-based, or a circular probe-based preparative method, and the other one is one or the other two types of method). Accordingly, in some embodiments the second preparative method is an amplification-based, a hybridization-based, or a circular probe-based preparative method, provided that the second method is different from the first method. However, in some embodiments, both methods may be of the same type, provided they are different methods (e.g., both are amplification based or hybridization-based, but are different types of amplification or hybridization methods, e.g., with different relative biases).

In amplification-based (e.g., PCR-based or LCR-based, etc.) preparative methods, genomic loci (target nucleic acids) are isolated directly by means of a polymerase chain reaction or ligase chain reaction (or other amplification method) that selectively amplifies each locus using a pair of oligonucleotide primers. It is to be understood that primers will be sufficiently complementary to the target sequence to hybridize with and prime amplification of the target nucleic acid. Any one of a variety of art known methods may be utilized for primer design and synthesis. One or both of the primers may be perfectly complementary to the target sequence.

Degenerate primers may also be used. Primers may also include additional nucleic acids that are not complementary to target sequences but that facilitate downstream applications, including for example restriction sites and identifier sequences (e.g., source sequences). PCR based methods may include amplification of a single target nucleic acid and multiplex amplification (amplification of multiple target nucleic acids in parallel).

Hybridization-based preparative may methods involve selectively immobilizing target nucleic acids for further manipulation. It is to be understood that one or more oligonucleotides (immobilization oligonucleotides), which in some embodiments may be from 10 to 200 nucleotides in length, are used which hybridize along the length of a target region of a genetic locus to immobilize it. In some embodiments, immobilization oligonucleotides are either immobilized before hybridization is performed (e.g., Roche/ Nimblegen 'sequence capture'), or are prepared such that they include a moiety (e.g., biotin) which can be used to selectively immobilize the target nucleic acid after hybridization by binding to e.g., streptavidin-coated microbeads (e.g., Agilent 'SureSelect').

Circularization selection-based preparative methods selectively convert each region of interest into a covalently-closed circular molecule which is then isolated by removal (usually enzymatic, e.g., with exonuclease) of any non-circularized linear nucleic acid. Oligonucleotide probes are designed which have ends that flank the region of interest. The probes are allowed to hybridize to the genomic target, and enzymes are used to first (optionally) fill in any gap between probe ends and second ligate the probe closed. In some embodiments, following circularization, any remaining (non-target) linear nucleic acid can be removed, resulting in isolation (capture) of target nucleic acid. Circularization selection-based preparative methods include molecular inversion probe capture reactions and 'selector' capture reactions. However, other techniques may be used as aspects of the invention are not limited in this respect. In some embodiments, molecular inversion probe capture of a target nucleic acid is indicative of the presence of a polymorphism in the target nucleic acid.

A variety of methods may be used to evaluate and compare bias profiles of each preparative technique. Next-generation sequencing may be used to quantitatively measure the abundance of each isolated target nucleic acid obtained from a certain preparative method. This abundance may be compared to a control abundance value (e.g., a known starting abundance of the target nucleic acid) and/or with an abundance determined through the use of an alternative preparative method. For example, a set of target nucleic acids may be isolated by one or more of the three preparative methods; the target nucleic acid may be observed x times using the amplification technique, y times using the hybridization enrichment technique, and z times using the circularization selection technique. A pairwise correlation coefficient may be computed between each abundance value (e.g., x and y, x and z, and y and z) to assess bias in nucleic acid isolation between pairs of preparative methods. Since the mechanisms of isolation are different in each approach, the abundances will usually be different and largely uncorrelated with each other.

In some embodiments, the invention provides a method of obtaining a nucleic acid preparation that is representative of a target nucleic acid in a biological sample by obtaining a first preparation of a target nucleic acid using a first preparative method on a biological sample, obtaining a second preparation of a target nucleic acid using a second preparative method on the biological sample, and combining the first and second nucleic acid preparations to obtain a combined preparation that is representative of the target nucleic acid in the biological sample.

In some embodiments of any of the methods described herein, a third preparation of the target nucleic acid is obtained using a third preparative method that is different from the first and second preparative methods, wherein the first, second, and third preparative methods all have different systematic sequence biases. In some embodiments of any of the methods described herein, the different preparative methods are used for a plurality of different loci in the biological sample to increase the sensitivity of a multiplex nucleic acid analysis. In some embodiments, the target nucleic acid has a sequence of a gene selected from Table 1.

However, it should be appreciated that a genotyping method of the invention may include several steps, each of which independently may involve one or more different preparative techniques described herein. In some embodiments, a nucleic acid preparation may be obtained using one or more (e.g., 2, 3, 4, 5, or more) different techniques described herein (e.g., amplification, hybridization capture, circular probe capture, etc., or any combination thereof) and the nucleic acid preparation may be analyzed using one or more different techniques (e.g., amplification, hybridization capture, circular probe capture, etc., or any combination thereof) that are selected independently of the techniques used for the initial preparation.

In some embodiments, aspects of the invention also provide compositions, kits, devices, and analytical methods for increasing the sensitivity of nucleic acid assays. Aspects of the invention are particularly useful for increasing the confidence level of genotyping analyses. However, aspects of the invention may be used in the context of any suitable nucleic acid analysis, for example, but not limited to, a nucleic acid analysis that is designed to determine whether more than one sequence variant is present in a sample.

In some embodiments, aspects of the invention relate to a plurality of nucleic acid probes (e.g., 10-50, 50-100, 100-250, 250-500, 500-1,000, 1,000-2,000, 2,000-5,000, 5,000-7,500, 7,500-10,000, or lower, higher, or intermediate number of different probes). In some embodiments, each probe or each of a subset of probes (e.g., 10-25%, 25-50%, 50-75%, 75-90%, or 90-99%) has a different first targeting arm. In some embodiments, each probe or each probe of a subset of probes (e.g., 10-25%, 25-50%, 50-75%, 75-90%, or 90-99%) has a different second targeting arm. In some embodiments, the first and second targeting arms are separated by the same intervening sequence. In some embodiments, the first and second targeting arms are complementary to target nucleic acid sequences that are separated by the same or a similar length (e.g., number of nucleic acids, for example, 0-25, 25-50, 50-100, 100-250, 250-500, 500-1, 000, 1,000-2,500 or longer or intermediate number of nucleotides) on their respective target nucleic acids (e.g., genomic loci). In some embodiments, each probe or a subset of probes (e.g., 10-25%, 25-50%, 50-75%, 75-90%, or 90-99%) includes a first primer binding sequence. In some embodiments, the primer binding sequence is the same (e.g., it can be used to prime sequencing or other extension reaction). In some embodiments, each probe or a subset of probes (e.g., 10-25%, 25-50%, 50-75%, 75-90%, or 90-99%) includes a unique identifier sequence tag (e.g., that is predetermined and can be used to distinguish each probe).

In some embodiments, the methods disclosed herein are useful for any application where sensitivity is important. For example, detection of cancer mutations in a heterogenous tissue sample, detection of mutations in maternally-circulating fetal DNA, and detection of mutations in cells isolated during a preimplantation genetic diagnostic procedure.

According to some aspects of the invention, methods of detecting a polymorphism in a nucleic acid in a biological sample are provided. In some embodiments, the methods comprise obtaining a nucleic acid preparation using a preparative method (e.g., any of the preparative methods disclosed herein) on a biological sample, and performing a molecular inversion probe capture reaction on the nucleic acid preparation, wherein a molecular inversion probe capture (e.g., using a mutation-detection MIP) of a target nucleic acid of the nucleic acid preparation is indicative of the presence of a mutation (polymorphism) in the target nucleic acid, optionally wherein the polymorphism is selected from Table 2.

According to some aspects of the invention, methods of genotyping a nucleic acid in a biological sample are provided. In some embodiments, the methods comprise obtaining a nucleic acid preparation using a preparative method on a biological sample, sequencing a target nucleic acid of the nucleic acid preparation, and performing a molecular inversion probe capture reaction on the biological sample, wherein a molecular inversion probe capture of the target nucleic acid in the biological sample is indicative of the presence of a polymorphism in the target nucleic acid, genotyping the target nucleic acid based on the results of the sequencing and the capture reaction.

In some embodiments of the methods disclosed herein, the target nucleic acid has a sequence of a gene selected from Table 1.

It should be appreciated that any one or more embodiments described herein may be used for evaluating multiple genetic markers in parallel. Accordingly, in some embodiments, aspects of the invention relate to determining the presence of one or more markers (e.g., one or more alleles) at multiple different genetic loci in parallel. Accordingly, the risk or presence of multiple heritable disorders may be evaluated in parallel. In some embodiments, the risk of having offspring with one or more heritable disorders may be evaluated. In some embodiments, an evaluation may be performed on a biological sample of a parent or a child (e.g., at a pre-implantation, prenatal, perinatal, or postnatal stage). In some embodiments, the disclosure provides methods for analyzing multiple genetic loci (e.g., a plurality of target nucleic acids selected from Table 1 or 2) from a patient sample, such as a blood, pre-implantation embryo, chorionic villus or amniotic fluid sample. A patient or subject may be a human. However, aspects of the invention are not limited to humans and may be applied to other species (e.g., mammals, birds, reptiles, other vertebrates or invertebrates) as aspects of the invention are not limited in this respect. A subject or patient may be male or female. In some embodiments, in connection with reproductive genetic counseling, samples from a male and female member of a couple may be analyzed. In some embodiments, for example, in connection with an animal breeding program, samples from a plurality of male and female subjects may be analyzed to determine compatible or optimal breeding partners or strategies for particular traits or to avoid one or more diseases or conditions. Accordingly, reproductive risks may be determined and/or reproductive recommendations may be provided based on information derived from one or more embodiments of the invention.

However, it should be appreciated that aspects of the invention may be used in connection with any medical evaluation where the presence of one or more alleles at a genetic locus of interest is relevant to a medical determination (e.g., risk or detection of disease, disease prognosis, therapy selection, therapy monitoring, etc.). Further aspects of the invention may be used in connection with detection, in tumor tissue or circulating tumor cells, of mutations in cellular pathways that cause cancer or predict efficacy of treatment regimens, or with detection and identification of pathogenic organisms in the environment or a sample obtained from a subject, e.g., a human subject.

These and other aspects of the invention are described in more detail in the following description and non-limiting examples and drawings.

BRIEF DESCRIPTION OF DRAWINGS

FIG. 15A discloses "GM1 7080" sequences as SEQ ID NO: 6328, 6329, and 6328 and FIG. 15B discloses the "GM1 7074" sequences as SEQ ID NO: 6328, 6328, and 6328, all respectively, in order of appearance.

FIG. 16A depicts an IGV view of NGS data from GM18540 for the genotype call of interest (shown between vertical lines) (FIG. 16A discloses SEQ ID NO: 6330-6331). FIG. 16B depicts bi-directional Sanger data for the variant-containing region. FIG. 16C depicts a histogram of allele ratios for all non-reference genotype calls in chromosome 11 derived from whole genome shotgun sequencing (WGSS) of GM18540 and control sample GM18537. FIG. 16D depicts genome-wide relative coverage for GM18540. WGSS coverage data for each of the 25 autosomes was binned into 50 Kb intervals and the log-ratio of the per-sample mean normalized values was plotted versus chromosome position. Dashed vertical lines denote chromosome boundaries; within a chromosome the ratios are arranged according to genomic position.

FIG. 17A depicts IGV of heterozygous splice site mutation c.3368−2A>T in sample GM12960 (FIG. 17A discloses SEQ ID NO: 6332-6333). FIG. 17B depicts IGV of heterozygous premature stop codon mutation R1158X in sample GM18802 (FIG. 17B discloses SEQ ID NO: 6334-

6335). FIG. 17C depicts Sanger data confirming existence of mutation c.3368-2A>T in sample GM12960 (FIG. 17C discloses SEQ ID NO: 6336 and 6336). FIG. 17D depicts Sanger data confirming existence of mutation R1158X in sample GM18802 (FIG. 17D discloses SEQ ID NO: 6337 and 6337).

FIGS. 18A-E depict next-generation DNA sequencing workflow according to certain embodiments. FIG. 18B discloses (top panel) SEQ ID NO: 6338-6349, (left panel) SEQ ID NO: 6338-6343, and (right panel) SEQ ID NO: 6344-6349, all respectively, in order of appearance. FIG. 18C discloses SEQ ID NO: 6350-6356, 6353, 6352, 6357, and 6357, respectively, in order of appearance. FIG. 18D discloses (left panel) SEQ ID NO: 6352, 6358, 6350, 6352, 6358, 6350, 6359, and 6359, and (right panel) SEQ ID NO: 6360, 6361, 6355, 6360, 6361, 6355, 6362, and 6363, all respectively, in order of appearance. FIG. 18E discloses (left panel) SEQ ID NO: 6358, 6352, and 6350, (right panel) SEQ ID NO: 6360, 6361, and 6355, and (bottom panel) SEQ ID NO: 6364 and 6364, all respectively, in order of appearance.

FIGS. 20A-1, 20A-2, 20A-3, 20B-1, 20B-2 and 20B-3 show NGS detection of allele dropout in Sanger reactions. FIG. 20A-1 discloses SEQ ID NO: 6371, 6372, and 6372, FIG. 20A-2 depicts SEQ ID NO: 6371, 6371, 6372, and FIG. 20A-3 discloses SEQ ID NOS 6373; and 6374, all respectively, in order of appearance. FIG. 20B-1 discloses SEQ ID NO: 6371, 6372, and 6372, FIG. 20B-2 discloses SEQ ID NO: 6371, 6371, 6372, and FIG. 20B-3 discloses SEQ ID NO: 6373 and 6374, all respectively, in order of appearance.

FIG. 24 shows analysis by GATA.

DETAILED DESCRIPTION

Figure 1:
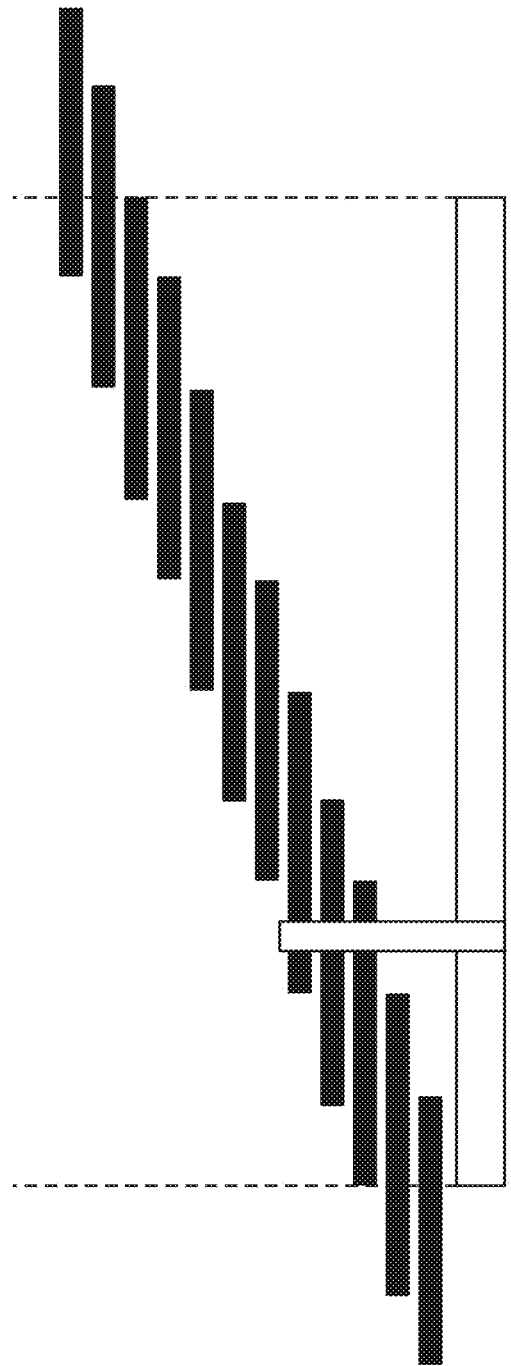
FIG. 1 illustrates a non-limiting embodiment of a tiled probe layout.

Aspects of the invention relate to preparative and analytical methods and compositions for evaluating genotypes, and in particular, for determining the allelic identity (or identities in a diploid organism) of one or more genetic loci in a subject. Aspects of the invention are based, in part, on the identification of different sources of ambiguity and error in genetic analyses, and, in part, on the identification of one or more approaches to avoid, reduce, recognize, and/or resolve these errors and ambiguities at different stages in a genetic analysis. Aspects of the invention relate to methods and compositions for addressing bias and/or stochastic variation associated with one or more preparative and/or analytical steps of a nucleic acid evaluation technology. In some embodiments, preparative methods can be adapted to avoid or reduce the risk of bias skewing the results of a genetic analysis. In some embodiments, analytical methods can be adapted to recognize and correct for data variations that may give rise to misinterpretation (e.g., incorrect calls such as homozygous when the subject is actually heterozygous or heterozygous when the subject is actually homozygous). Methods of the invention may be used for any type of mutation, for example a single base change (e.g., insertion, deletion, transversion or transition, etc.), a multiple base insertion, deletion, duplication, inversion, and/or any other change or combination thereof.

In some embodiments, additional or alternative techniques may be used to address loci characterized by multiple repeats of a core sequence where the length of the repeat is longer than a typical sequencing read thereby making it difficult to determine whether a deletion or duplication of one or more core sequence units has occurred based solely on a sequence read. In some embodiments, increased confidence in an assay result may be obtained by i) selecting two or more different preparative and/or analytical techniques that have different biases (e.g., known to have different biases), ii) evaluating a patient sample using the two or more different techniques, iii) comparing the results from the two or more different techniques, and/or iv) determining whether the results are consistent for the two or more different techniques. In some embodiments, if determining in step (iv) indicates that the results are consistent (e.g., the same) then increased confidence in the assay result is obtained. In other embodiments, if determining in step (iv) indicates that the results are inconsistent (e.g., that the results are ambiguous) then one or more additional preparative and/or analytical techniques, which have a different bias (e.g., known to have a different bias) compared with the two or more different preparative and/or analytical techniques selected in step (i), are used to evaluate the patient sample, and the results of the one or more additional preparative and/or analytical techniques are compared with the results from step (ii) to resolve the inconsistency.

In some embodiments, two or more independent samples may be obtained from a subject and independently analyzed. In some embodiments, two or more independent samples are obtained at approximately the same time point. In some embodiments, two or more independent samples are obtained at multiple different time points. In some embodiments, the use of two or more independent sample facilitates the elimination, normalization, and/or quantification of stochastic measurement noise. It is to be appreciated that two or more independent samples may be obtained in connection with any of the methods disclosed herein, including, for example, methods for pathogen profiling in a human or other animal subjects, monitoring tumor progression/regression, analyzing circulating tumor cells, analyzing fetal cells in maternal circulation, and analyzing/monitoring/profiling of environmental pathogens.

In some embodiments, one or more of the techniques described herein may be combined in a single assay protocol for evaluating multiple patient samples in parallel.

It should be appreciated that aspects of the invention may be useful for high throughput, cost-effective, yet reliable, genotyping of multiple patient samples (e.g., in parallel, for example in multiplex reactions). In some embodiments, aspects of the invention are useful to reduce the error frequency in a multiplex analysis. Certain embodiments may be particularly useful where multiple reactions (e.g., multiple loci and/or multiple patient samples) are being processed. For example, 10-25, 25-50, 50-75, 75-100 or more loci may be evaluated for each subject out of any number of subject samples that may be processed in parallel (e.g., 1-25, 25-50, 50-100, 100-500, 500-1,000, 1,000-2,500, 2,500-5,000 or more or intermediate numbers of patient samples). It should be appreciated that different embodiments of the invention may involve conducting two or more target capture reactions and/or two or more patient sample analyses in parallel in a single multiplex reaction. For example, in some embodiments a plurality of capture reactions (e.g., using different capture probes for different target loci) may be performed in a single multiplex reaction on a single patient sample. In some embodiments, a plurality of captured nucleic acids from each one of a plurality of patient samples may be combined in a single multiplex analysis reaction. In some embodiments, samples from different subjects are tagged with subject-specific (e.g., patient-specific) tags (e.g., unique sequence tags) so that the information from each product can be assigned to an identified subject. In some embodiments, each of the different capture probes used for each patient sample have a common patient-specific tag. In some embodiments, the capture probes do not have patient-specific tags, but the captured products from each subject may be amplified using one or a pair of amplification primers that are labeled with a patient-specific tag. Other techniques for associating a patient-specific tag with the captured product from a single patient sample may be used as aspects of the invention are not limited in this respect. It should be appreciated that patient-specific tags as used herein may refer to unique tags that are assigned to identified patients in a particular assay. The same tags may be used in a separate multiplex analysis with a different set of patient samples (e.g., from different patients) each of which is assigned one of the tags. In some embodiments, different sets of unique tags may be used in sequential (e.g., alternating) multiplex reactions in order to reduce the risk of contamination from one assay to the next and allow contamination to be detected on the basis of the presence of tags that are not expected to be present in a particular assay.

Embodiments of the invention may be used for any of a number of different settings: reproductive settings, disease screening, identifying subjects having cancer, identifying subjects having increased risk for a disease, stratifying a population of subjects according to one or more of a number of factors, for example responsiveness to a particular drug, lack or not of an adverse reaction (or risk therefore) to a particular drug, and/or providing information for medical records (e.g., homozygosity, heterozygosity at one or more loci). It should be appreciated that the invention is not limited to genomic analysis of patient samples. For example, aspects of the invention may be useful for high throughput genetic analysis of environment samples to detect pathogens.

In some embodiments, the methods disclosed herein are useful for diagnosis of one or more heritable disorders. In some embodiments, a heritable disorder that may be diagnosed with the methods disclosed herein is a genetic disorder that is prevalent in the Ashkenazi Jewish population. In some embodiments, the heritable disorders are selected from: 21-Hydroxylase-Deficient Congenital Adrenal Hyperplasia; ABCC8-Related Hyperinsulinism; Alpha-Thalassemia, includes Constant Spring, & MR associated; Arylsulfatase A Deficiency-Metyachromatic Leukodystrophy; Biotimidase Deficiency-Holocarboxylase Synthetase Deficiency; Bloom's Syndrome; Canavan Disease; CFTR-Related Disorders-cystic fibrosis; Citrullinemia Type I; Combined MMA & Homocystinuria-db1C; Dystrophinopathies (DMD & BMD); Familial Dysautonomia; Fanconi Anemia-FANCC; Galactosemia-C1-assical: Galactokinase Deficiency & Galactose Epimerase Deficiency; Gaucher Disease; GJB2-Related DFNB 1 Nonsyndromic Hearing Loss and Deafness; Glutaric acidemia Type 1; Hemoglobinopathies beta-chain disorders; Glycogen Storage Disease Type 1A; Maple Syrup Urine Disease; Types 1A, 1B, 2, 3; Medium Chain Acyl-Coenzyme A; Dehydrogenase Deficiency-MCADD; Methylmalonic Acidemia; Mucolipidosis IV; Nemaline Myopathy; Nieman-Pick Type A-Acid Sphingomyelinase Deficiency; Non-Ketotic Hyperglycinemia-Glycine Encephalopathy; Ornithine Transcarbamylase Deficiency; PKU Phenylalanine Hydroxylase Deficiency; Propionic Acidemia; Short Chain Acyl-CoA Dehydrogenase Deficiency-SCADD; Smith-Lemli-Opitz Syndrome; Spinal Muscular Atrophy (SMN1)-SMA; Tay Sachs-HexA Deficiency; Usher Syndrome-Type I (Type IB, Type IC, Type ID, Type IF, Type IG); X-Linked Mental Retardation ARX-Related Disorders; X-Linked Mental Retardation with Cerebellar Cypoplasia and distinctive Facial Appearance; X-Linked Mental Retardation; includes 9, 21, 30, 46, 58, 63, 88, 89; X-linked mental retardation: FM1-Related Disorders-FRXA, Fragile X MR; X-linked SMR: Renpenning Syndrome 1; Zellweger Spectrum disorders-Peroxisomal Bifunctional Enzyme Deficiencies including Zellweger, NALD, and/or infantile Refsums. However, all of these, subsets of these, other genes, or combinations thereof may be used.

According to some aspects, the disclosure relates to multiplex diagnostic methods. In some embodiments, multiplex diagnostic methods comprise capturing a plurality of genetic loci in parallel (e.g., a genetic locus of Table 1). In some embodiments, genetic loci possess one or more polymorphisms (e.g., a polymorphism of Table 2) the genotypes of which correspond to disease causing alleles. Accordingly, in some embodiments, the disclosure provides methods for assessing multiple heritable disorders in parallel.

In some embodiments, methods are provided for diagnosing multiple heritable disorders in parallel at a pre-implantation, prenatal, perinatal, or postnatal stage. In some embodiments, the disclosure provides methods for analyzing multiple genetic loci (e.g., a plurality of target nucleic acids selected from Table 1) from a patient sample, such as a blood, pre-implantation embryo, chorionic villus or amniotic fluid sample. A patient or subject may be a human. However, aspects of the invention are not limited to humans and may be applied to other species (e.g., mammals, birds, reptiles, other vertebrates or invertebrates) as aspects of the invention are not limited in this respect. A subject or patient may be male or female. In some embodiments, in connection with reproductive genetic counseling, samples from a male and female member of a couple may be analyzed. In some embodiments, for example, in connection with an animal breeding program, samples from a plurality of male and female subjects may be analyzed to determine compatible or optimal breeding partners or strategies for particular traits or to avoid one or more diseases or conditions.

However, it should be appreciated that any other diseases may be studied and/or risk factors for diseases or disorders including, but not limited to allergies, responsiveness to treatment, cancer tumor profiling for treatment and prognosis, monitoring and identification of patient infections, and monitoring of environmental pathogens.

1. Reducing Representational Bias in Multiplex Amplification Reactions:

In some embodiments, aspects of the invention relate to methods that reduce bias and increase reproducibility in multiplex detection of genetic loci, e.g., for diagnostic purposes. Molecular inversion probe technology is used to detect or amplify particular nucleic acid sequences in potentially complex mixtures. Use of molecular inversion probes has been demonstrated for detection of single nucleotide polymorphisms (Hardenbol et al. 2005 Genome Res 15:269-75) and for preparative amplification of large sets of exons (Porreca et al. 2007 Nat Methods 4:931-6, Krishnakumar et al. 2008 Proc Natl Acad Sci USA 105:9296-301). One of the main benefits of the method is in its capacity for a high degree of multiplexing, because generally thousands of targets may be captured in a single reaction containing thousands of probes. However, challenges associated with, for example, amplification efficiency (See, e.g., Turner E H, et al., Nat. Methods. 2009 Apr. 6:1-2) have limited the practical utility of the method in research and diagnostic settings.

Aspects of the disclosure are based, in part, on the discovery of effective methods for overcoming challenges associated with systematic errors (bias) in multiplex genomic capture and sequencing methods, namely high variability in target nucleic acid representation and unequal sampling of heterozygous alleles in pools of captured target nucleic acids (e.g., isolated from a biological sample). Accordingly, in some embodiments, the disclosure provides methods that reduce variability in the detection of target nucleic acids in multiplex capture methods. In other embodiments, methods improve allelic representation in a capture pool and, thus, improve variant detection outcomes. In certain embodiments, the disclosure provides preparative methods for capturing target nucleic acids (e.g., genetic loci) that involve the use of different sets of multiple probes (e.g., molecular inversion probes MIPs) that capture overlapping regions of a target nucleic acid to achieve a more uniform representation of the target nucleic acids in a capture pool compared with methods of the prior art. In other embodiments, methods reduce bias, or the risk of bias, associated with large scale parallel capture of genetic loci, e.g., for diagnostic purposes. In other embodiments, methods are provided for increasing reproducibility (e.g., by reducing the effect of polymorphisms on target nucleic acid capture) in the detection of a plurality of genetic loci in parallel. In further embodiments, methods are provided for reducing the effect of probe synthesis and/or probe amplification variability on the analysis of a plurality of genetic loci in parallel.

In some aspects, the disclosure provides probe sets that comprise a plurality of different probes. As used herein, a 'probe' is a nucleic acid having a central region flanked by a 5' region and a 3' region that are complementary to nucleic acids flanking the same strand of a target nucleic acid or subregion thereof. An exemplary probe is a molecular inversion probe (MIP). A 'target nucleic acid' may be a genetic locus. Exemplary genetic loci are disclosed herein in Table 1 (RefSeqGene Column).

While probes have been typically designed to meet certain constraints (e.g. melting temperature, G/C content, etc.) known to partially affect capture/amplification efficiency (Ball et al (2009) Nat Biotech 27:361-8 AND Deng et al (2009) Nat Biotech 27:353-60), a set of constraints which is sufficient to ensure either largely uniform or highly reproducible capture/amplification efficiency has not previously been achieved. As disclosed herein, uniformity and reproducibility can be increased by designing multiple probes per target, such that each base in the target is captured by more than one probe. In some embodiments, the disclosure provides multiple MIPs per target to be captured, where each MIP in a set designed for a given target nucleic acid has a central region and a 5' region and 3' region ('targeting arms') which hybridize to (at least partially) different nucleic acids in the target nucleic acid (immediately flanking a subregion of the target nucleic acid). Thus, differences in efficiency between different targeting arms and fill-in sequences may be averaged across multiple MIPs for a single target, which results in more uniform and reproducible capture efficiency.

In some embodiments, the methods involve designing a single probe for each target (a target can be as small as a single base or as large as a kilobase or more of contiguous sequence).

It may be preferable, in some cases, to design probes to capture molecules (e.g., target nucleic acids or subregions thereof) having lengths in the range of 1-200 bp (as used herein, a by refers to a base pair on a double-stranded nucleic acid-however, where lengths are indicated in bps, it should be appreciated that single-stranded nucleic acids having the same number of bases, as opposed to base pairs, in length also are contemplated by the invention). However, probe design is not so limited. For example, probes can be designed to capture targets having lengths in the range of up to 10, 20, 30, 40, 50, 60, 70, 80, 90, 100, 200, 300, 400, 500, 1000, or more bps, in some cases.

It is to be appreciated that the length of a capture molecule (e.g., a target nucleic acid or subregion thereof) is selected based upon multiple considerations. For example, where analysis of a target involves sequencing, e.g., with a next-generation sequencer, the target length should typically match the sequencing read-length so that shotgun library construction is not necessary. However, it should be appreciated that captured nucleic acids may be sequenced using any suitable sequencing technique as aspects of the invention are not limited in this respect.

It is also to be appreciated that some target nucleic acids are too large to be captured with one probe. Consequently, it may be necessary to capture multiple subregions of a target nucleic acid in order to analyze the full target.

In some embodiments, a subregion of a target nucleic acid is at least 1 bp. In other embodiments, a subregion of a target nucleic acid is at least 10, 20, 30, 40, 50, 60, 70, 80, 90, 100, 200, 300, 400, 500, 600, 700, 800, 900, 1000 bp or more. In other embodiments, a subregion of a target nucleic acid has a length that is up to 10%, 20%, 30%, 40%, 50%, 60%, 70%, 80%, 90%, 95%, or more percent of a target nucleic acid length.

The skilled artisan will also appreciate that consideration is made, in the design of MIPs, for the relationship between probe length and target length. In some embodiments, MIPs are designed such that they are several hundred basepairs (e.g., up to 100, 200, 300, 400, 500, 600, 700, 800, 900, 1000 bp or more) longer than corresponding target (e.g., subregion of a target nucleic acid, target nucleic acid).

In some embodiments, lengths of subregions of a target nucleic acid may differ. For example, if a target nucleic acid contains regions for which probe hybridization is not possible or inefficient, it may be necessary to use probes that capture subregions of one or more different lengths in order to avoid hybridization with problematic nucleic acids and capture nucleic acids that encompass a complete target nucleic acid.

Aspects of the invention involve using multiple probes, e.g., MIPs, to amplify each target nucleic acid. In some embodiments, the set of probes for a given target can be designed to 'tile' across the target, capturing the target as a series of shorter sub-targets. In some embodiments, where a set of probes for a given target is designed to 'tile' across the target, some probes in the set capture flanking non-target sequence). Alternately, the set can be designed to 'stagger' the exact positions of the hybridization regions flanking the target, capturing the full target (and in some cases capturing flanking non-target sequence) with multiple probes having different targeting arms, obviating the need for tiling. The particular approach chosen will depend on the nature of the target set. For example, if small regions are to be captured, a staggered-end approach might be appropriate, whereas if longer regions are desired, tiling might be chosen. In all cases, the amount of bias-tolerance for probes targeting pathological loci can be adjusted ('dialed in') by changing the number of different MIPs used to capture a given molecule. In some embodiments, the 'coverage factor', or number of probes used to capture a basepair in a molecule, is an important parameter to specify. Different numbers of probes per target are indicated depending on whether one is using the tiling approach (see, e.g., FIG. 1) or one of the staggered approaches (see, e.g., FIG. 2 or 3).

FIG. 1 illustrates a non-limiting embodiment of a tiled probe layout showing ten captured sub-targets tiled across a single target. Each position in the target is covered by three sub-targets such that MIP performance per base pair is averaged across three probes.

Figure 2:
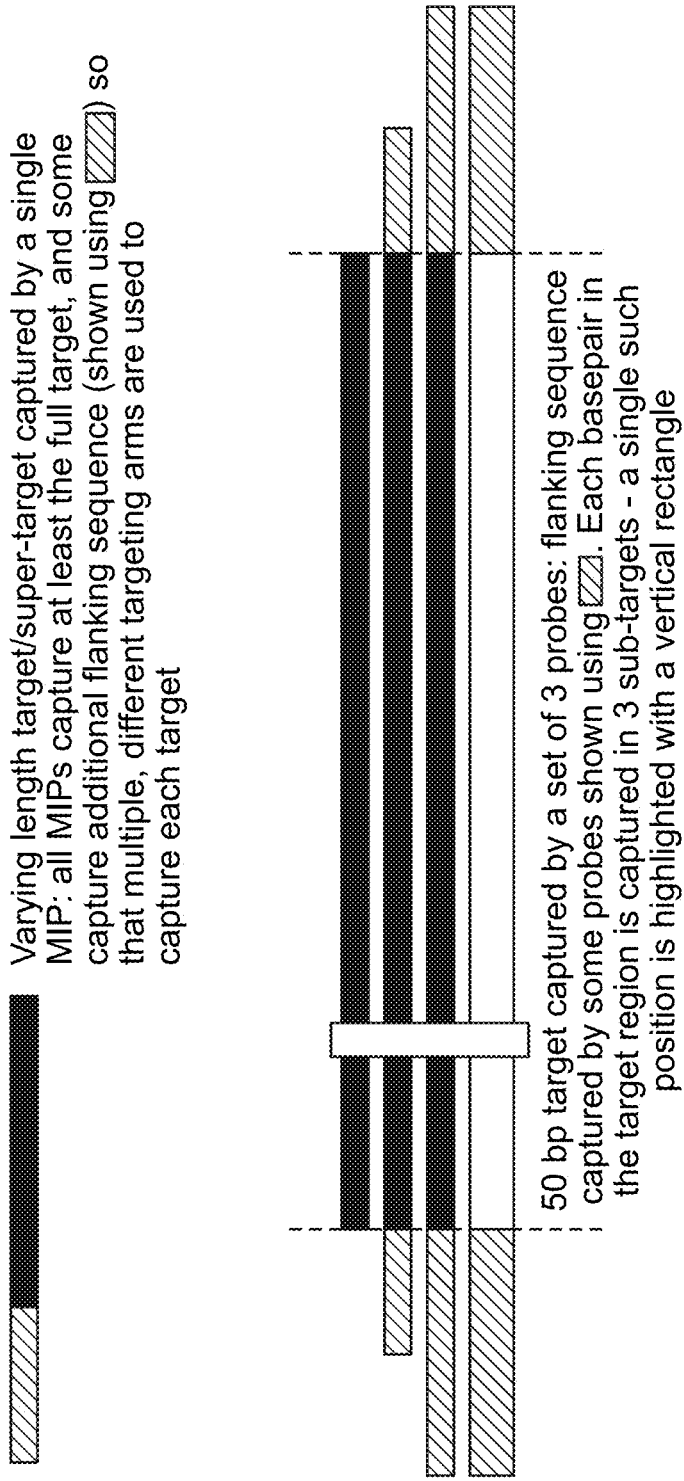
FIG. 2 illustrates a non-limiting embodiment of a staggered probe layout.

FIG. 2 illustrates a non-limiting embodiment of a staggered probe layout showing the targets captured by a set of three MIPs. Each MIP captures the full target, shown in black, plus (in some cases) additional extra-target sequence, shown in gray, such that the targeting arms of each MIP fall on different sequence. Each position in the target is covered by three sub-targets such that MIP performance per basepair is averaged across three probes. Targeting arms land immediately adjacent to the black or gray regions shown. It should be appreciated that in some embodiments, the targeting arms (not shown) can be designed so that they do not overlap with each other.

Figure 3:
FIG. 3 illustrates a non-limiting embodiment of an alternating staggered probe layout.
Figure 3:
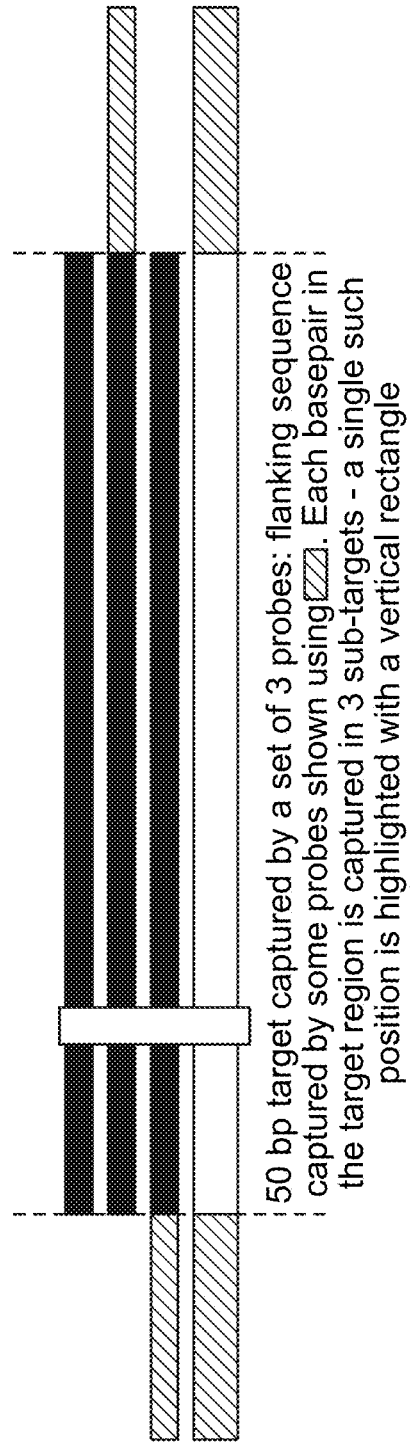

FIG. 3 illustrates a non-limiting embodiment of an alternating staggered probe layout showing the targets captured by a set of three MIPs. Each MIP captures the full target, shown in black, plus (in some cases) additional extra-target sequence, shown in gray, such that the targeting arms of each MIP fall on different sequence. Each position in the target is covered by three sub-targets such that MIP performance per basepair is averaged across three probes. Targeting arms land immediately adjacent to the black or gray regions shown.

It should be appreciated that for any of the layouts, the targeting arms on adjacent tiled or staggered probes may be designed to either overlap, not overlap, or overlap for only a subset of the probes.

In certain embodiments for any of the layouts, a coverage factor of about 3 to to about 10 is used. However, the methods are not so limited and coverage factors of up to 2, 3, 4, 5, 6, 7, 8, 9, 10, 20 or more may be used. It is to be appreciated that the coverage factor selected may depend the probe layout being employed. For example, in the tiling approach, for a desired coverage factor, the number of probes per target is typically a function of target length, sub-target length, and spacing between adjacent sub-target start locations (step size). For example, for a desired coverage factor of 3, a 200 bp target with a start-site separation of 20 bp and sub-target length of 60 bp may be encompassed with 12 MIPs (FIG. 1). Thus, a specific coverage factor may be achieved by varying the number of probes per target nucleic acid and the length of the molecules captured. In the staggered approach, a fixed-length target nucleic acid is captured as several subregions or as 'super-targets', which are molecules comprising the target nucleic acid and additional flanking nucleic acids, which may be of varying lengths. For example, a target of 50 bp can be captured at a coverage factor of 3 with 3 probes in either a 'staggered' (FIG. 2) or 'alternating staggered' configuration (FIG. 3).

The coverage factor will be driven by the extent to which detection bias is tolerable. In some cases, where the bias tolerance is small, it may be desirable to target more subregions of target nucleic acid with, perhaps, higher coverage factors. In some embodiments, the coverage factor is up to 2, 3, 4, 5, 6, 7, 8, 9, 10 or more.

In some embodiments, when a tiled probe layout is used, when the target length is greater than 1 bp and when a step size (distance between the 5'-end of a target and the 5' end of its adjacent target) is less than the length of a target or subregion thereof, it is possible to compute probe number for a particular target based on target length (T), sub-target length (S), and coverage factor (C), such that probe number=T/(S/C)+(C−1).

In some aspects, the disclosure provides methods to increase the uniformity of amplification efficiency when multiple molecules are amplified in parallel; methods to increase the reproducibility of amplification efficiency; methods to reduce the contribution of targeting probe variability to amplification efficiency; methods to reduce the effect on a given target nucleic acid of polymorphisms in probe hybridization regions; and/or methods to simplify downstream workflows when multiplex amplification by MIPs is used as a preparative step for analysis by nucleic acid sequencing.

Polymorphisms in the target nucleic acid under the regions flanking a target can interfere with hybridization, polymerase fill-in, and/or ligation. Furthermore, this may occur for only one allele, resulting in allelic drop-out, which ultimately decreases downstream sequencing accuracy. In some embodiments, using a set of MIPs having multiple hybridization sites for the capture of any given target, the probability of loss from polymorphism is substantially decreased because not all targeting arms in the set of MIPs will cover the location of the mutation.

Probes for MIP capture reactions may be synthesized on programmable microarrays because of the large number of sequences required. Because of the low synthesis yields of these methods, a subsequent amplification step is required to produce sufficient probe for the MIP amplification reaction. The combination of multiplex oligonucleotide synthesis and pooled amplification results in uneven synthesis error rates and representational biases. By synthesizing multiple probes for each target, variation from these sources may be averaged out because not all probes for a given target will have the same error rates and biases.

Multiplex amplification strategies disclosed herein may be used analytically, as in detection of SNPs, or preparatively, often for next-generation sequencing or other sequencing techniques. In the preparative setting, the output of an amplification reaction is generally the input to a shotgun library protocol, which then becomes the input to the sequencing platform. The shotgun library is necessary in part because next-generation sequencing yields reads significantly shorter than amplicons such as exons. In addition to the bias-reduction afforded by the multi-tiled approach described here, tiling also obviates the need for shotgun library preparation. Since the length of the capture molecule can be specified when the probes, e.g., MIPs, are designed, it can be chosen to match the readlength of the sequencer. In this way, reads can 'walk' across an exon by virtue of the start position of each capture molecule in the probe set for that exon.

Exemplary molecular inversion probes are provided in Appendix A. These molecular inversion probes are designed to capture targets or sub-regions thereof on one or more genes listed in Table 5 (provided in Example 8). In certain applications, the molecular inversion probes provided in Appendix A may be used to tile-capture targets or sub-regions thereof on the one or more genes provided in Table 5. In particular applications, two or more of the molecular inversion probes of Appendix A tile across different, but overlapping sub-regions of one or more genes listed in Table 5 so that a target on the gene is capture by both of the two or more molecular inversion probes, as exemplified in FIG. 1.

In certain embodiments, the molecular inversion probes of Appendix A that are chosen for tile-capture a target depends on the desired amount of overlapping coverage for the target. In one example, two or more molecular inversion probes of Appendix A, being in directly ascending SEQ ID NO: order and corresponding to a target nucleic acid, will tile across the target nucleic acid with a period of 25 base pairs such that every genomic position of the target nucleic acid is capture by multiple probes with orthogonal targeting arm sequences. If less coverage is desired for a target nucleic acid, one may select, for example, every other molecular inversion probes of Appendix A in ascending order that correspond to that target.

The first and second targeting arms of the molecular inversion probes are designed to hybridize to nucleotides upstream and downstream of a capture region of a gene (i.e. the targeting arms flank the region to be captured). The capture region may be a target nucleic acid or a sub-region thereof. Appendix B lists the capture regions of the genes that correspond to the molecular inversion probes listed in Appendix A. Appendix A also specifies the upstream and downstream regions of the capture regions corresponding to each targeting arm of the molecular inversion probes. The upstream and downstream regions of the capture region are between the start position and the end position coordinates, which are relative to the Human Genome 18 (HG 18).

The molecular inversion probes of Appendix A include a central region flanked by a 5' first targeting arm (i.e. ligation arm or left arm) and a 3' second targeting arm (i.e. extension arm or right arm). The targeting arm sequences are shown in lowercase letters and the central region sequence is shown in uppercase letters. The 5' first targeting arm and the 3' second targeting arm of the molecular inversion probes provided in Appendix A include a total of 40 nucleotides, and are designed to flank 130 bp capture regions. Some of the molecular inversion probes listed in Appendix A are designed to capture the coding regions of the genes, whereas others are designed to capture non-coding regions of the genes. The genes listed in Table 5 corresponded to diseases, and as such, the molecular inversion probes listed in Appendix A can be utilized to analyze one or more of the diseases provided in table 5. The molecular inversion probes provided in Appendix A are described in more detail in Example 8.

While all of the molecular inversion probes provided in Appendix A may be used in a single assay to comprehensively examine several or all of the genomic regions of the genes provided in Table 5, one may also select one or more molecular inversion probes provided in Appendix A to evaluate one or more targets present in one gene or a combination of the genes provided in Table 5. For example, one may choose to only examine the coding regions of one or more of the genes listed in Table 5, and therefore use the one or more of the molecular inversion probes designed to capture those regions. In another example, one may choose to only examine the non-coding regions of one or more gene listed in Table 5, and therefore use the one or more molecular inversion probes designed to capture those regions. In another example, one may choose to only examine a portion of or the entirety of a gene listed in Table 5, and therefore use the one or more molecular inversion probes design to capture the portion of or the entirety of that gene. In another example, one may choose to examine nucleic acid regions specific to one or more diseases listed in Table 5, and therefore use the one or more nucleic acids corresponding to those diseases. In yet another example, one may choose to examine a portion or entirety of two or more of the genes listed in Table 5, and there uses the molecular inversion probes specific to those genes. In yet another example, one may choose to only examine certain chromosomes with the molecular inversion probes provided in Appendix A. In all of these examples, the number of molecular inversion probes that correspond to the target chosen depends on the amount of coverage one desires.

It is understood that one can modify the molecular inversion probes listed in Appendix A, while achieving a similar coverage and tile-capture layout as the probes listed in Appendix A. For example, the sequence of the central region of the molecular inversion probes may be different from the sequence of the central region provided in Appendix A without changing capture region of the probe. For molecular inversion probe sets, the sequence chosen for the central region is preferably the same across each molecular inversion probe in a set of probes. This allows the capture targets to be amplified with a single set of primers. It is also preferable that the central region is designed so that it is not complementary to the target sequences or any other sequence in the sample.

In addition, it should be appreciated that other molecular inversion probes than those listed in Appendix A may be used to tile-capture different regions of the genes listed in Table 5. Those molecular inversion probes may include a different first targeting arm, second targeting arm, and/or central region from the molecular inversion probes listed in Appendix A. In a non-limiting example, a modified molecular inversion probe may include the first targeting arm sequence of SEQ ID NO: 300, but have a different sequence for the central region and the second targeting arm. The specific sequences and length of the sequences chosen for the first targeting arm, second targeting arm, and/or central region depend on the desired capture region and coverage.

In certain embodiments, the molecular inversion probes for tile or staggered capture are selected to maximize performance with respect to both capture efficiency and robustness to common polymorphisms. In order to determine which probes maximize performance for a genomic target, methods of the invention, according to certain aspects, involve designing all possible probes capable of targeting a genomic interval and ranking the probes based on a number of score tuples or ranking factors. In certain embodiments, the possible probes are assigned score tuples including, but not limited to: 1) presence of guanine or cytosine as the 5'-most base of the ligation arm, 2) the number of dbSNP (version 130) entries intersecting targeting arm sites, 3) the root mean squared deviation of the targeting arms' predicted melting temperatures from optimal values derived from empirical studies of efficiencies. Using any combination of these score tuples, the possible probes for a certain genomic interval may be ranked, and the highest ranking probe for the genomic interval is preferably chosen for capture.

In certain aspects, method of the invention provide for shearing or fragmenting genomic nucleic acid prior to performing capture with a molecular inversion probe (e.g. capture with one or more of the molecular inversion probes provided in Appendix A). Fragmenting the genomic nucleic acid prior to performing a capture reaction allows for greater exposure of a target site to a molecular inversion probe, which reduces failed capture and increases the percentage of molecular inversion probes that hybridize to targets within the genome. This advantageously yields a target abundance distribution that is significantly more uniform than if a native high molecular weight genomic nucleic acid is used. Molecular inversion techniques involving a fragmenting step are described in co-owned and co-assigned U.S. Ser. No. 13/448,961, having U.S. Publication No. 2012/0252020, entitled "Capture Reactions."

Fragmenting the nucleic acid can be accomplished by any technique known in the art. Exemplary techniques include mechanically fragmenting, chemically fragmenting, and/or enzymatically fragmenting. Mechanical nucleic acid fragmentation can be, for example, sonication, nebulization, and hydro-shearing (e.g., point-sink shearing). Enzymatic nucleic acid fragmenting includes, for example, use of nicking endonucleases or restriction endonucleases. The nucleic acid can also be chemically fragmented by performing acid hydrolysis on the nucleic acid or treating of the nucleic acid with alkali or other reagents.

The fragment length can be adjusted based on the sizes of the nucleic acid targets to be captured. The nucleic acid fragments can be of uniform length or of a distribution of lengths. In certain embodiments, the nucleic acid is fragmented into nucleic acid fragments having a length of about 10 kb or 20 kb. In addition, the nucleic acid fragments can range from between 1 kb to 20 kb, with various distributions.

In certain embodiments, the nucleic acid is also denatured, which may occur prior to, during, or after the fragmenting step. The nucleic acid can be denatured using any means known in the art, such as pH-based denaturing, heat-based denaturing, formamide or urea, exonuclease degradation, or endonuclease nicking. In certain embodiments, the use of pH, such as in acid hydrolysis, alone or in combination with heat fragments and either partially or fully denatures the nucleic acid. This combined fragmenting and denaturing method can be used to fragment the nucleic acid for MIP capture or to fragment captured target nucleic acids or whole genomic DNA for shotgun library preparation.

In one aspect, a nucleic acid is fragmented by heating a nucleic acid immersed in a buffer system at a certain temperature for a certain period to time to initiate hydrolysis and thus fragment the nucleic acid. The pH of the buffer system, duration of heating, and temperature can be varied to achieve a desired fragmentation of the nucleic acid. In one embodiment, after a genomic nucleic acid is purified, it is resuspended in a Tris-based buffer at a pH between 7.5 and 8.0, such as Qiagen's DNA hydrating solution. The resuspended genomic nucleic acid is then heated to 65° C. and incubated overnight (about 16-24 hours) at 65° C. Heating shifts the pH of the buffer into the low- to mid-6 range, which leads to acid hydrolysis. Over time, the acid hydrolysis causes the genomic nucleic acid to fragment into single-stranded and/or double-stranded products. The above method of fragmenting can be modified by increasing the temperature and reducing the heating time. For example, a nucleic acid is fragmented by incubating the nucleic acid in the Tris-based buffer at a pH between 7.5 and 8.0 for 15 minutes at 92° C. In addition to adjusting the temperature and the duration of heating, the pH of the Tris-based buffer can be adjusted to achieve a desired nucleic acid fragmentation.

Once molecular inversion probes of the invention are hybridized to genomic or fragmented nucleic acid, the captured target may further be subjected to an enzymatic gap-filling and ligation step, such that a copy of the target sequence is incorporated into a circle. Capture efficiency of the MIP to the target sequence on the nucleic acid fragment can be improved by lengthening the hybridization and gap-filing incubation periods. (See, e.g., Turner E H, et al., Nat Methods. 2009 Apr. 6:1-2).

The result of molecular inversion probe capture as described above is a library of circular target probes, which then can be processed in a variety of ways. In one aspect, adaptors for sequencing can be attached during common linker-mediated PCR, resulting in a library with non-random, fixed starting points for sequencing. In another aspect, for preparation of a shotgun library, a common linker-mediated PCR is performed on the circle target probes, and the post-capture amplicons are linearly concatenated, sheared, and attached to adaptors for sequencing. Methods for shearing the linear concatenated captured targets can include any of the methods disclosed for fragmenting nucleic acids discussed above. In certain aspects, performing a hydrolysis reaction on the captured amplicons in the presence of heat is the desired method of shearing for library production.

Sequencing may be by any method known in the art. DNA sequencing techniques include classic dideoxy sequencing reactions (Sanger method) using labeled terminators or primers and gel separation in slab or capillary, sequencing by synthesis using reversibly terminated labeled nucleotides, pyrosequencing, 454 sequencing, Illumina/Solexa sequencing, allele specific hybridization to a library of labeled oligonucleotide probes, sequencing by synthesis using allele specific hybridization to a library of labeled clones that is followed by ligation, real time monitoring of the incorporation of labeled nucleotides during a polymerization step, polony sequencing, and SOLiD sequencing. Separated molecules may be sequenced by sequential or single extension reactions using polymerases or ligases as well as by single or sequential differential hybridizations with libraries of probes.

An example of a sequencing technology that can be used is Illumina sequencing. Illumina sequencing is based on the amplification of DNA on a solid surface using fold-back PCR and anchored primers. Genomic DNA is fragmented, and adapters are added to the 5' and 3' ends of the fragments. DNA fragments that are attached to the surface of flow cell channels are extended and bridge amplified. The fragments become double stranded, and the double stranded molecules are denatured. Multiple cycles of the solid-phase amplification followed by denaturation can create several million clusters of approximately 1,000 copies of single-stranded DNA molecules of the same template in each channel of the flow cell. Primers, DNA polymerase and four fluorophore-labeled, reversibly terminating nucleotides are used to perform sequential sequencing. After nucleotide incorporation, a laser is used to excite the fluorophores, and an image is captured and the identity of the first base is recorded. The 3' terminators and fluorophores from each incorporated base are removed and the incorporation, detection and identification steps are repeated. Sequencing according to this technology is described in U.S. Pat. Nos. 7,960,120; 7,835,871; 7,232,656; 7,598,035; 6,911,345; 6,833,246; 6,828,100; 6,306,597; 6,210,891; U.S. Pub. 2011/0009278; U.S. Pub. 2007/0114362; U.S. Pub. 2006/0292611; and U.S. Pub. 2006/0024681, each of which are incorporated by reference in their entirety.

Sequencing generates a plurality of reads. Reads generally include sequences of nucleotide data less than about 150 bases in length, or less than about 90 bases in length. In certain embodiments, reads are between about 80 and about 90 bases, e.g., about 85 bases in length. In some embodiments, these are very short reads, i.e., less than about 50 or about 30 bases in length. A set of sequence reads can be analyzed by any suitable method known in the art. For example, in some embodiments, sequence reads are analyzed by hardware or software provided as part of a sequence instrument. In some embodiments, individual sequence reads are reviewed by sight (e.g., on a computer monitor). A computer program may be written that pulls an observed genotype from individual reads. In certain embodiments, analyzing the reads includes assembling the sequence reads and then genotyping the assembled reads.

In certain embodiments, the sequences obtained using the molecular inversion probe techniques of the invention are analyzed using the methods for evaluating of genetic test, which are described in U.S. Provisional Ser. No. 61/723,508, entitled "Validation of Genetic Test." The method involves obtaining a plurality of sequence reads, introducing a simulated mutation into at least one of the plurality of sequence reads, and analyzing the sequence reads to determine if the test identifies the simulated mutation. To mimic the expected genotype of a heterozygous carrier, the simulated mutation can be introduced into each of those sequence reads that span a location of the mutation with a probability of 0.5 (e.g., into about half of those sequence reads that should contain the location of the simulated mutation). The simulated mutation can be introduced by manipulating a data field in the sequence read such as, for example, a base sequence field or quality data field. The sequences can be manipulated by a computer program. For example, a program can be written using Java, Groovy, Python, Perl, or other languages, or a combination thereof, that can automatically insert simulated mutations into sequence reads. Computer-based methods can be used to automatically introduce a number of different simulated mutations into different ones of the plurality of sequence reads.

The sequence reads including the manipulated reads are analyzed to detect a genotype. Analysis can include any method known in the art, such as de nova assembly, alignment to a reference, or a combination thereof. In some embodiments, the sequence reads are assembled into a contig. The contig can be aligned to a reference genome. In certain embodiments, individual reads are then aligned back to the contig.

Sequence assembly can be done by methods known in the art including reference-based assemblies, de novo assemblies, assembly by alignment, or combination methods. Assembly can include methods described in U.S. Pat. No. 8,209,130 titled Sequence Assembly by Porecca and Kennedy, the contents of each of which are hereby incorporated by reference in their entirety for all purposes. In some embodiments, sequence assembly uses the low coverage sequence assembly software (LOCAS) tool described by Klein, et al., in LOCAS-A low coverage sequence assembly tool for re-sequencing projects, PLoS One 6(8) article 23455 (2011), the contents of which are hereby incorporated by reference in their entirety. Sequence assembly is described in U.S. Pat. Nos. 8,165,821; 7,809,509; 6,223,128; U.S. Pub. 2011/0257889; and U.S. Pub. 2009/0318310, the contents of each of which are hereby incorporated by reference in their entirety.

Figure 21:
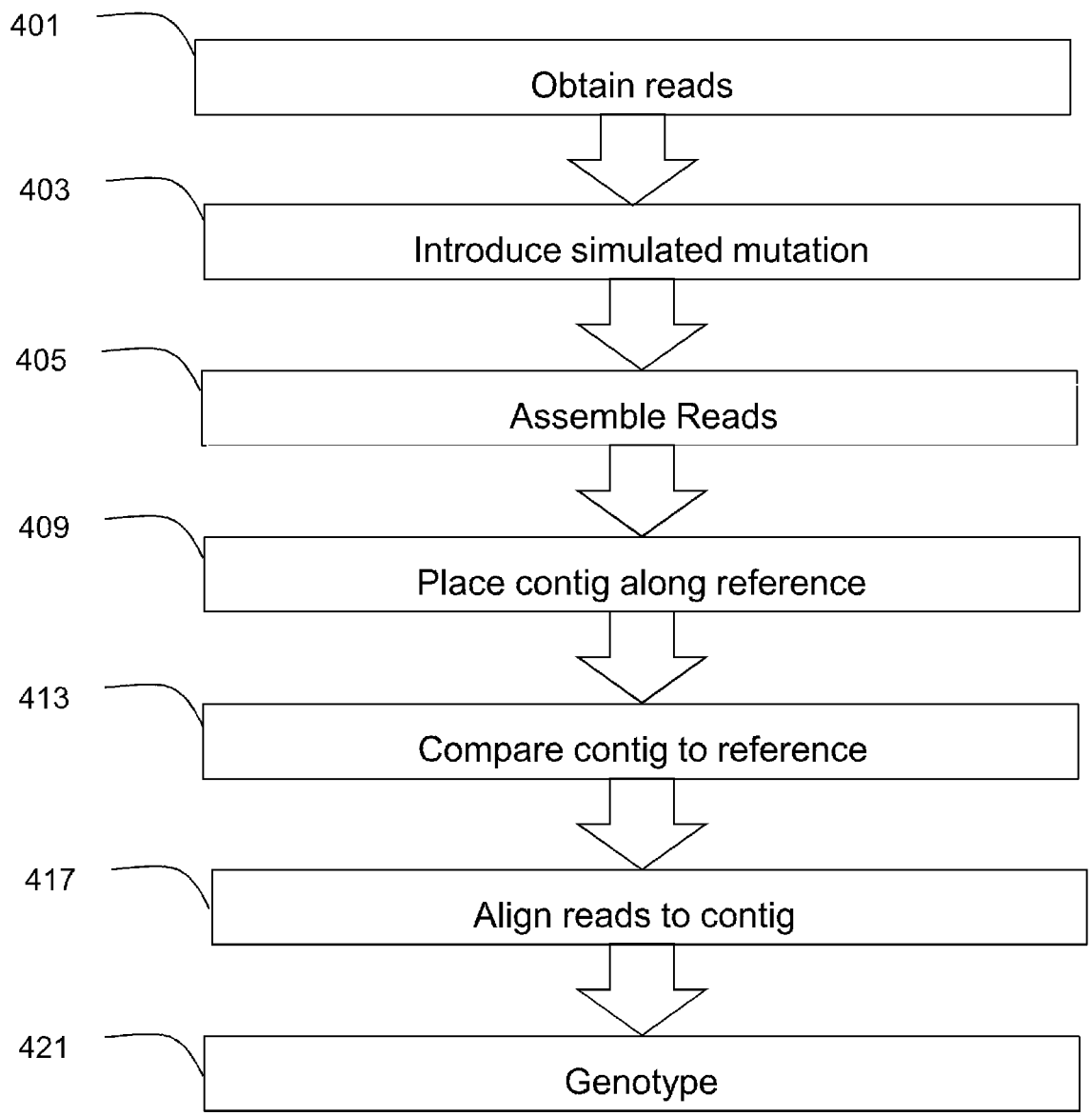
FIG. 21 diagrams use of methods of the invention to validate a genotyping by assembly-templated alignment (GATA) technique.

In certain embodiments, genetic test of the invention are validated using a genotyping by assembly-template alignment (GATA) technique, which is also described in co-pending and co-owned U.S. Provisional Ser. No. 61/723,508, entitled "Validation of Genetic Test." FIG. 21 diagrams the validation of a genotyping by assembly-templated alignment (GATA) technique. Genetic analysis by GATA-based methods includes obtaining 401 sequence reads and assembling 405 the reads into a contig, which is then aligned 409 to a reference. Differences are identified by comparison 413. The raw reads are aligned 417 to the contigs and positional and variant information is mapped to the reads from the reference via the contig, allowing genotyping 421 to produce an observed genotyping. The GATA-based method is evaluated by introducing 403 at least one simulated mutation into the reads.

Figure 22:
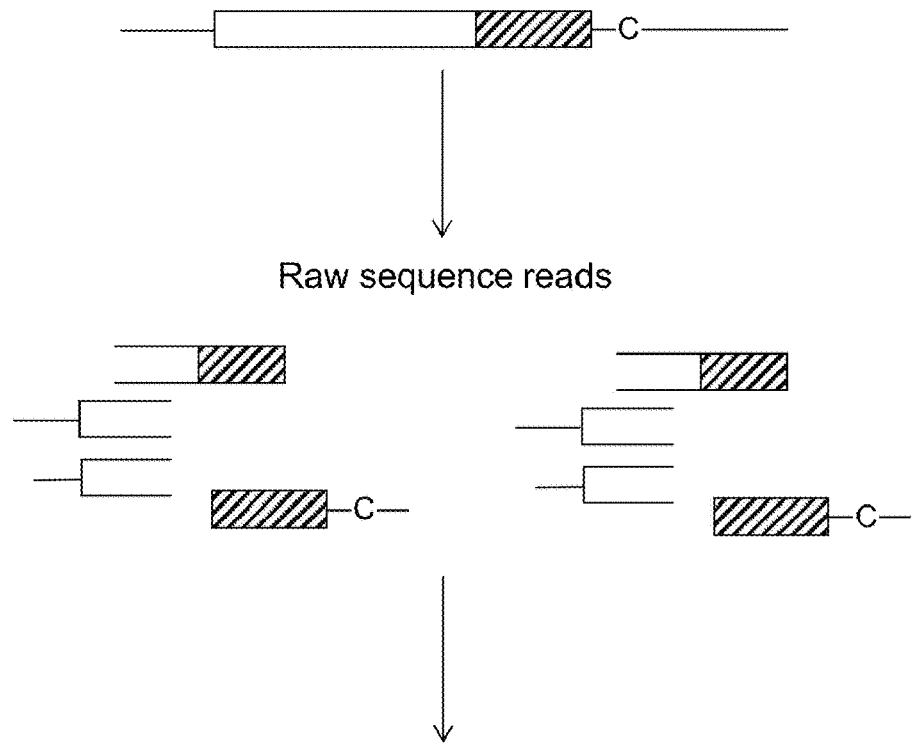
FIG. 22 illustrates obtaining sequence reads and inserting a simulated mutation.
Figure 22:
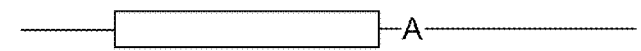
Figure 22:

FIG. 22 illustrates obtaining sequence reads and inserting a simulated mutation. As shown in FIG. 22, if only wild type sample is sequenced, the raw sequence reads may only include wild type sequence. However, a mutation of interest may be known, for example, from the literature or it may be desirable to simply invent a difficult-to-detect mutation to use in methods of validating a genetic analysis. Here, a hypothetical 8 base pair deletion proximal to a C>A substitution is depicted. As shown in FIG. 22, the raw sequence reads are edited so that they include base sequence data, quality data, or both that would arise from sequencing the simulated mutation.

Figure 23:
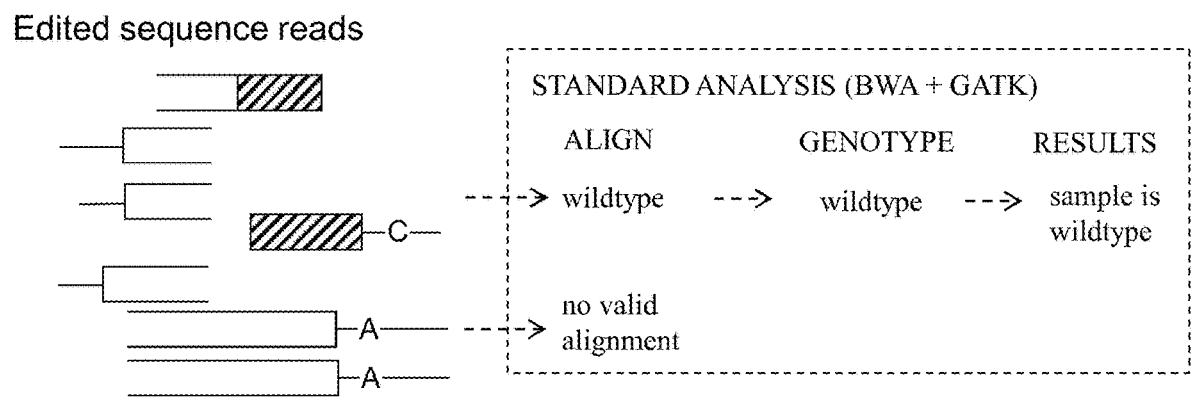
FIG. 23 shows standard analysis of sequence reads for comparison to GATA.

FIG. 23 shows an example in which a standard analytical method is performed for comparison to a GATA-based method. The standard analysis is demonstrated to not be able to detect a mutation. FIG. 23 depicts a workflow in which edited sequence reads (e.g., as depicted in FIG. 22) are aligned to a reference genome (here, using BWA and GATK). The alignment software properly aligns the wild type sequence reads to the reference genome, finding a perfect match and giving a result indicating that the sample is the wild type. However, the alignment software finds no valid alignment for the edited sequence reads and is unable to produce a result. Due to the fact that the expected genotype of the edited sequence reads is known a priori (and, in fact intentionally supplied by editing), an operator is able to identify that this analysis method-alignment of sequence reads to a reference genome—is incapable of detecting the mutation. For comparison, the sequence reads are also analyzed by a GATA-based method.

FIG. 24 shows analysis of sequence reads that include simulated mutations by GATA. In step 1, reads are assembled into contigs. Assembly can include any method including those discussed below. In step 2, each contig is aligned to a reference genome. Alignment can be by any method such as those discussed below, including, e.g., the bwa-sw algorithm implemented by BWA. As shown in FIG. 24, both align to the same reference position. Differences between the contig and the reference genome are identified and, as shown in FIG. 26, described by a CIGAR string.

In step 3, raw reads are aligned to contigs (using any method such as, for example, BWA with bwa-short and writing, for example, a CIGAR string). At step 4, raw read alignments are mapped from contig space to original reference space (e.g., via position and CIGAR information). In step 5, genotyping is performed using the translated, aligned reads from step 4 (e.g., including raw quality scores for substitutions).

For step 1, reads may be assembled into contigs by any method known in the art. Algorithms for the de nova assembly of a plurality of sequence reads are known in the art. One algorithm for assembling sequence reads is known as overlap consensus assembly. Assembly with overlap graphs is described, for example, in U.S. Pat. No. 6,714,874. In some embodiments, de nova assembly proceeds according to so-called greedy algorithms, as described in U.S. Pub. 2011/0257889, incorporated by reference in its entirety. In other embodiments, assembly proceeds by either exhaustive or heuristic pairwise alignment. Exhaustive pairwise alignment, sometimes called a "brute force" approach, calculates an alignment score for every possible alignment between every possible pair of sequences among a set. Assembly by heuristic multiple sequence alignment ignores certain mathematically unlikely combinations and can be computationally faster. One heuristic method of assembly by multiple sequence alignment is the so-called "divide-and-conquer" heuristic, which is described, for example, in U.S. Pub. 2003/0224384. Another heuristic method of assembly by multiple sequence alignment is progressive alignment, as implemented by the program ClustalW (see, e.g., Thompson, et al., Nucl. Acids. Res., 22:4673-80 (1994)).

With continuing reference to step 1 of FIG. 24, in some embodiments assembly into contigs involves making a de Bruijn graph. De Bruijn graphs reduce the computation effort by breaking reads into smaller sequences of DNA, called k-mers, where the parameter k denotes the length in bases of these sequences. In a de Bruijn graph, all reads are broken into k-mers (all subsequences of length k within the reads) and a path between the k-mers is calculated. In assembly according to this method, the reads are represented as a path through the k-mers. The de Bruijn graph captures overlaps of length k–1 between these k-mers and not between the actual reads. By reducing the entire data set down to k-mer overlaps, the de Bruijn graph reduces the high redundancy in short-read data sets. Assembly of reads using de Bruijn graphs is described in U.S. Pub. 2011/0004413, U.S. Pub. 2011/0015863, and U.S. Pub. 2010/0063742, incorporated by reference in their entirety. Assembly of reads into contigs is further discussed in U.S. Pat. No. 6,223,128, U.S. Pub. 2009/0298064, U.S. Pub. 2010/0069263, and U.S. Pub. 2011/0257889, each of which is incorporated by reference herein in its entirety.

2. Reducing Analytical Errors Associated with Bias in Nucleic Acid Preparations:

In some embodiments, aspects of the invention relate to preparative steps in DNA sequencing-related technologies that reduce bias and increase the reliability and accuracy of downstream quantitative applications.

There are currently many genomics assays that utilize next-generation (polony-based) sequencing to generate data, including genome resequencing, RNA-seq for gene expression, bisulphite sequencing for methylation, and Immuneseq, among others. In order to make quantitative measurements (including genotype calling), these methods utilize the counts of sequencing reads of a given genomic locus as a proxy for the representation of that sequence in the original sample of nucleic acids. The majority of these techniques require a preparative step to construct a high-complexity library of DNA molecules that is representative of a sample of interest. This may include chemical or biochemical treatment of the DNA (e.g., bisulphite treatment), capture of a specific subset of the genome (e.g., padlock probe capture, solution hybridization), and a variety of amplification techniques (e.g., polymerase chain reaction, whole genome amplification, rolling circle amplification).

Systematic and random errors are common problems associated with genome amplification and sequencing library construction techniques. For example, genomic sequencing library may contain an over- or under-representation of particular sequences from a source genome as a result of errors (bias) in the library construction process. Such bias can be particularly problematic when it results in target sequences from a genome being absent or undetectable in the sequencing libraries. For example, an under-representation of particular allelic sequences (e.g., heterozygotic alleles) from a genome in a sequencing library can result in an apparent homozygous representation in a sequencing library. As most downstream sequencing library quantification techniques depend on stochastic counting processes, these problems have typically been addressed by sampling enough (over-sampling) to obtain a minimum number of observations necessary to make statistically significant decisions. However, the strategy of oversampling is generally limited to elimination of low-count Poisson noise, and the approach wastes resources and increases the expense required to perform such experiments. Moreover, oversampling can result in a reduced statistical confidence in certain conclusions (e.g., diagnostic calls) based on the data. Accordingly, new approaches are needed for overcoming bias in sequencing library preparatory methods.

Aspects of the disclosure are based, in part, on the discovery of methods for overcoming problems associated with systematic and random errors (bias) in genome capture, amplification and sequencing methods, namely high variability in the capture and amplification of nucleic acids and disproportionate representation of heterozygous alleles in sequencing libraries. Accordingly, in some embodiments, the disclosure provides methods that reduce variability in the capture and amplification of nucleic acids. In other embodiments, the methods improve allelic representation in sequencing libraries and, thus, improve variant detection outcomes. In certain embodiments, the disclosure provides preparative methods for capturing target nucleic acids (e.g., genetic loci) that involve the use of differentiator tag sequences to uniquely tag individual nucleic acid molecules. In some embodiments, the differentiator tag sequence permits the detection of bias based on the frequency with which pairs of differentiator tag and target sequences are observed in a sequencing reaction. In other embodiments, the methods reduce errors caused by bias, or the risk of bias, associated with the capture, amplification and sequencing of genetic loci, e.g., for diagnostic purposes.

Aspects of the invention relate to associating unique sequence tags (referred to as differentiator tag sequences) with individual target molecules that are independently captured and/or analyzed (e.g., prior to amplification or other process that may introduce bias). These tags are useful to distinguish independent target molecules from each other thereby allowing an analysis to be based on a known number of individual target molecules. For example, if each of a plurality of target molecule sequences obtained in an assay is associated with a different differentiator tag, then the target sequences can be considered to be independent of each other and a genotype likelihood can be determined based on this information. In contrast, if each of the plurality of target molecule sequences obtained in the assay is associated with the same differentiator tag, then they probably all originated from the same target molecule due to over-representation (e.g., due to biased amplification) of this target molecule in the assay. This provides less information than the situation where each nucleic acid was associated with a different differentiator tag. In some embodiments, a threshold number of independently isolated molecules (e.g., unique combinations of differentiator tag and target sequences) is analyzed to determine the genotype of a subject.

Figure 4:
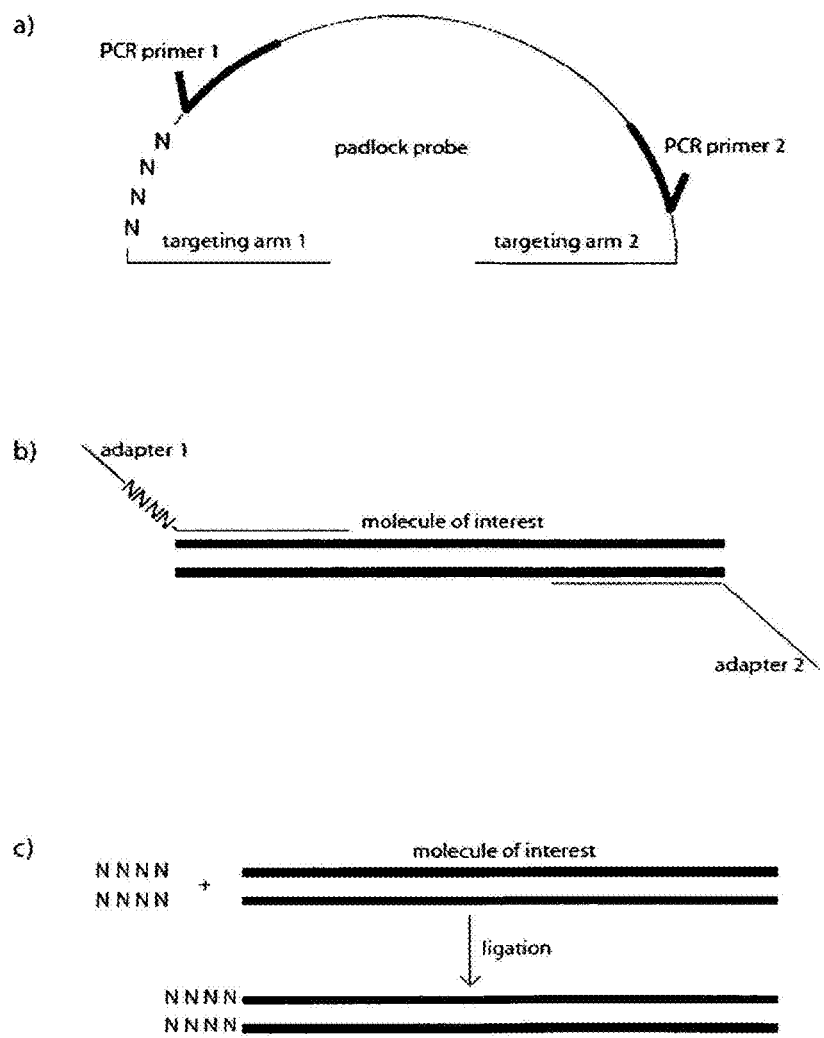
FIG. 4, panels a), b), and c) depict various non-limiting methods for combining differentiator tag sequence and target sequences (NNNN depicts a differentiator tag sequence)

In some embodiments, the invention relates to compositions comprising pools (libraries) of preparative nucleic acids that each comprise "differentiator tag sequences" for detecting and reducing the effects of bias, and for genotyping target nucleic acid sequences. As used herein, a "differentiator tag sequence" is a sequence of a nucleic acid (a preparative nucleic acid), which in the context of a plurality of different isolated nucleic acids, identifies a unique, independently isolated nucleic acid. Typically, differentiator tag sequences are used to identify the origin of a target nucleic acid at one or more stages of a nucleic acid preparative method. For example, in the context of a multiplex nucleic acid capture reaction, differentiator tag sequences provide a basis for differentiating between multiple independent, target nucleic acid capture events. Also, in the context of a multiplex nucleic acid amplification reaction, differentiator tag sequences provide a basis for differentiating between multiple independent, primary amplicons of a target nucleic acid, for example. Thus, combinations of target nucleic acid and differentiator tag sequence (target:differentiator tag sequences) of an isolated nucleic acid of a preparative method provide a basis for identifying unique, independently isolated target nucleic acids. FIG. 4A-C depict various non-limiting examples of methods for combining differentiator tag sequence and target sequences.

It will be apparent to the skilled artisan that differentiator tags may be synthesized using any one of a number of different methods known in the art. For example, differentiator tags may be synthesized by random nucleotide addition. Differentiator tag sequences are typically of a pre-defined length, which is selected to control the likelihood of producing unique target:differentiator tag sequences in a preparative reaction (e.g., amplification-based reaction, a circularization selection-based reaction, e.g., a MIP reaction). Differentiator tag sequences may be, up to 5, up to 6, up to 7 up to 8, up to 9, up to 10, up to 11, up to 12, up to 13, up to 14, up to 15, up to 16, up to 17, up to 18, up to 19, up to 20, up to 21, up to 22, up to 23, up to 24, up to 25, or more nucleotides in length. For purposes of genotyping, isolated nucleic acids are identified as independently isolated if they comprise unique combinations of target nucleic acid and differentiator tag sequences, and observance of threshold numbers of unique combinations of target nucleic acid and differentiator tag sequences provide a certain statistical confidence in the genotype.

During a library preparation process, each nucleic acid molecule may be tagged with a unique differentiator tag sequence in a configuration that permits the differentiator tag sequence to be sequenced along with the target nucleic acid sequence of interest (the nucleic acid sequence for which the library is being prepared, e.g., a polymorphic sequence). The incorporation of the nucleic acid comprising a differentiator tag sequence at a particular step allows the detection and correction of biases in subsequent steps of the protocol.

A large library of unique differentiator tag sequences may be created by using degenerate, random-sequence polynucleotides of defined length. The differentiator tag sequences of the polynucleotides may be read at the final stage of the sequencing. The observations of the differentiator tag sequences may be used to detect and correct biases in the final sequencing read-out of the library. For example, the total possible number of differentiator tag sequences, which may be produced, e.g., randomly, is 4N, where N is the length of the differentiator tag sequence. Thus, it is to be understood that the length of the differentiator tag sequence may be adjusted such that the size of the population of MIPs having unique differentiator tag sequences is sufficient to produce a library of MIP capture products in which identical independent combinations of target nucleic acid and differentiator tag sequence are rare. As used herein combinations of target nucleic acid and differentiator tag sequences, may also be referred to as "target:differentiator tag sequences".

In the final readout of a sequencing process, each read may have an additional unique differentiator tag sequence. In some embodiments, when differentiator tag sequences are distributed randomly in a library, all the unique differentiator tag sequences will be observed about an equal number of times. Accordingly, the number of occurrences of a differentiator tag sequence may follow a Poisson distribution.

In some embodiments, overrepresentation of target:differentiator tag sequences in a pool of preparative nucleic acids (e.g., amplified MIP capture products) is indicative of bias in the preparative process (e.g., bias in the amplification process). For example, target:differentiator tag sequence combinations that are statistically overrepresented are indicative of bias in the protocol at one or more steps between the incorporation of the differentiator tag sequences into MIPs and the actual sequencing of the MIP capture products.

The number of reads of a given target:differentiator tag sequence may be indicative (may serve as a proxy) of the amount of that target sequence present in the originating sample. In some embodiments, the numbers of occurrence of sequences in the originating sample is the quantity of interest. For example, using the methods disclosed herein, the occurrence of differentiator tag sequences in a pool of MIPs may be predetermined (e.g., may be the same for all differentiator tag sequences). Accordingly, changes in the occurrence of differentiator tag sequences after amplification and sequencing may be indicative of bias in the protocol. Bias may be corrected to provide an accurate representation of the composition of the original MIP pool, e.g., for diagnostic purposes.

According to some aspects, a library of preparative nucleic acid molecules (e.g., MIPs, each nucleic acid in the library having a unique differentiator tag sequence, may be constructed such that the number of nucleic acid molecules in the library is significantly larger than the number prospective target nucleic acid molecules to be captured using the library. This ensures that products of the preparative methods include only unique target:differentiator tag sequence; e.g., in a MIP reaction the capture step would undersample the total population of unique differentiator tag sequences in the MIP library. For example, an experiment utilizing 1 μg of genomic DNA will contain about ~150,000 copies of a diploid genome. For a MIP library, each MIP in the library comprising a randomly produced 12-mer differentiator tag sequence (~4.6 million possible unique differentiator tag sequences), there would be more than 100 unique differentiator tag sequences per genomic copy. For a MIP library, each MIP in the library comprising a randomly produced 15-mer differentiator tag sequence C1 billion possible unique differentiator tag sequences), there would be more than 7000 unique differentiator tag sequences per genomic copy. Therefore, the probability of the same differentiator tag sequence being incorporated multiple times is incredibly small. Thus, it is to be appreciated that the length of the differentiator tag sequence is to be selected based on the amount of target sequence in a MIP capture reaction and the desired probability for having multiple, independent occurrences of target:differentiator tag sequence combinations.

Figure 5:
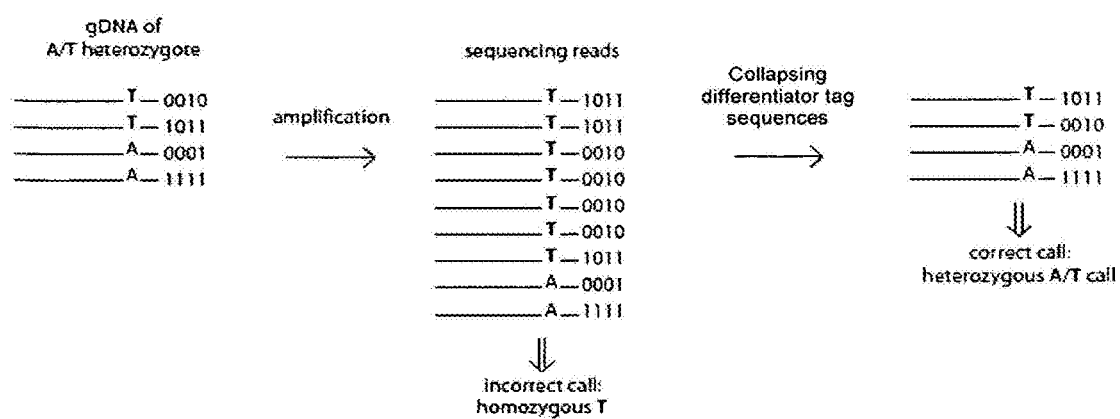
FIG. 5 depicts a non-limiting method for genotyping based on target and differentiator tag sequences.
Figure 6:
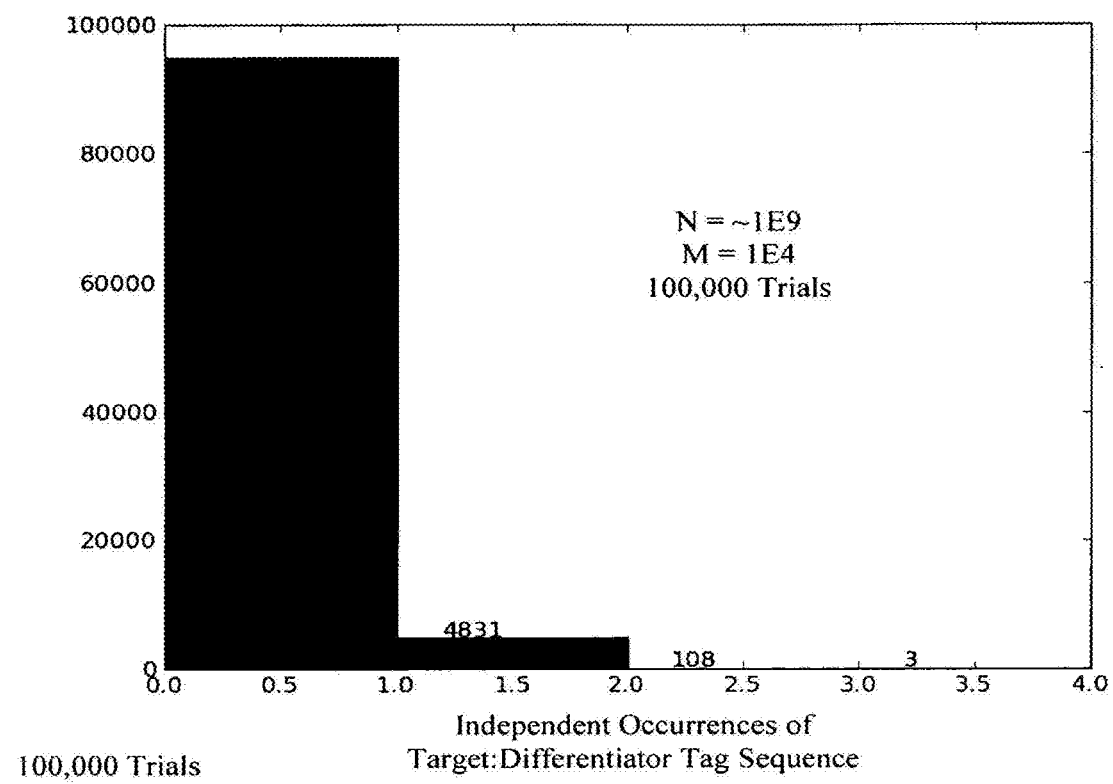
FIG. 6 depicts non-limiting results of a simulation of a MIP capture reaction.
Figure 7:
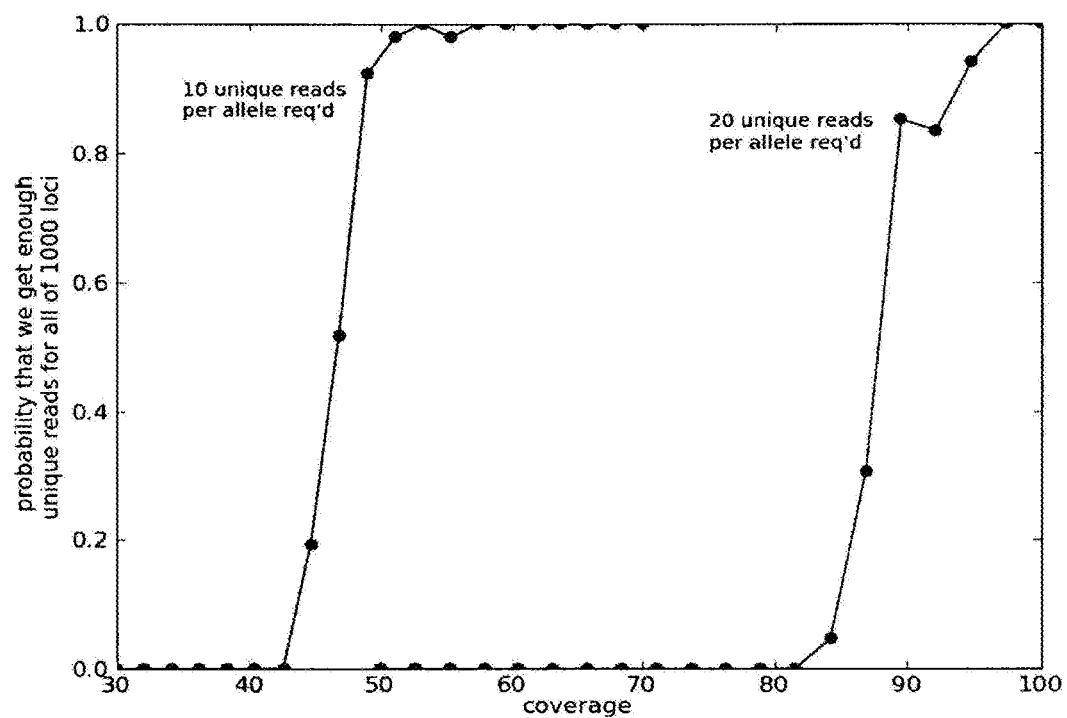
FIG. 7 depicts a non-limiting graph of sequencing coverage.

FIG. 5 depicts a non-limiting method for genotyping based on target and differentiator tag sequences. Sequencing reads of target and differentiator tags sequences are collapsed to make diploid genotype calls. FIG. 6 depicts non-limiting results of a simulation of a MIP capture reaction in which MIP probes, each having a differentiator tag sequence of 15 nucleotides, are combined with 10000 target sequence copies (e.g., genome equivalents). In this simulated reaction, the probability of capturing one or more copies of a target sequence having the same differentiator tag sequence is 0.05. The Y axis reflects the number of observations. The X axis reflects the number of independent occurrences of target:differentiator tag combinations. FIG. 7 depicts a non-limiting graph of sequencing coverage, which can help ensure that alleles are sampled to sufficient depth (e.g., either 10× or 20× minimum sampling per allele, assuming 1000 targets). In this non-limiting example, the X axis is total per-target coverage required, and the Y axis is the probability that a given total coverage will result in at least 10× or 20× coverage for each allele.

The skilled artisan will appreciate that as part of a MIP library preparation process, adapters may be ligated onto the ends of the molecules of interest. Adapters often contain PCR primer sites (for amplification or emulsion PCR) and/or sequencing primer sites. In addition, barcodes may be included, for example, to uniquely identify individual samples (e.g., patient samples) that may be mixed together. (See, e.g., USPTO Publication Number US 2007/0020640 A1 (McCloskey et al) The actual incorporation of the random differentiator tag sequences can be performed through various methods known in the art. For example, nucleic acids comprising differentiator tag sequences may be incorporated by ligation. This is a flexible method, because molecules having differentiator tag sequence can be ligated to any blunt-ended nucleic acids. The sequencing primers must be incorporated subsequently such that they sequence both the differentiator tag sequence and the target sequence. Alternatively, the sequencing adaptors can be synthesized with the random differentiator tag sequences at their 3' end (as degenerate bases), so that only one ligation must be performed. Another method is to incorporate the differentiator tag sequence into a PCR primer, such that the primer structure is arranged with the common adaptor sequence followed by the random differentiator tag sequence followed by the PCR priming sequence (in 5' to 3' order). A differentiator tag sequence and adaptor sequence (which may contain the sequencing primer site) are incorporated as tags. Another method to incorporate the differentiator tag sequences is to synthesize them into a padlock probe prior to performing a gene capture reaction. The differentiator tag sequence is incorporated 3' to the targeting arm but 5' to the amplification primer that will be used downstream in the protocol. Another method to incorporate the differentiator tag sequences is as a tag on a gene-specific or poly-dT reverse-transcription primer. This allows the differentiator tag sequence to be incorporated directly at the cDNA level.

In some embodiments, at the incorporation step, the distribution of differentiator tag sequences can be assumed to be uniform. In this case, bias in any part of the protocol would change the uniformity of this distribution, which can be observed after sequencing. This allows the differentiator tag sequence to be used in any preparative process where the ultimate output is sequencing of many molecules in parallel.

Differentiator tag sequences may be incorporated into probes (e.g., MIPs) of a plurality when they are synthesized on-chip in parallel, such that degeneracy of the incorporated nucleotides is sufficient to ensure near-uniform distribution in the plurality of probes. It is to be appreciated that amplification of a pool of unique differentiator tag sequences may itself introduce bias in the initial pool. However, in most practical cases, the scale of synthesis (e.g., by column synthesis, chip based synthesis, etc.) is large enough that amplification of an initial pool of differentiator tag sequences is not necessary. By avoiding amplification or selection steps on the pool of unique differentiator tag sequences, potential bias may be minimized.

One example of the use of the differentiator tag sequences is in genome re-sequencing. Considering that the raw accuracy of most next-generation sequencing instruments is relatively low, it is crucial to oversample the genomic loci of interest. Furthermore, since there are two alleles at every locus, it is important to sample enough to ensure that both alleles have been observed a sufficient number of times to determine with a sufficient degree of statistical confidence whether the sample is homozygous or heterozygous. Indeed, the sequencing is performed to sample the composition of molecules in the originating sample. However, after multiple reads have been collected for a given locus, it is possible that due to bias (e.g., caused by PCR amplification steps), a large fraction of the reads are derived from a single originating molecule. This would skew the population of target sequences observed, and would affect the outcome of the genotype call. For example, it is possible that a locus that is heterozygous is called as homozygous, because there are only a few observations of the second allele out of many observations of that locus. However, if information is available on differentiator tag sequences, this situation could be averted, because the over-represented allele would be seen to also have an over-represented differentiator tag sequence (i.e., the sequences with the overrepresented differentiator tag sequence all originated from the same single molecule). Therefore, the sequences and corresponding distribution of differentiator tag sequences can be used as an additional input to the genotype-calling algorithm to significantly improve the accuracy and confidence of the genotype calls.

In some aspects, the disclosure provides methods for analyzing a plurality of to target sequences which are genetic loci or portions of genetic loci (e.g., a genetic locus of Table 1). The genetic loci may be analyzed by sequencing to obtain a genotype at one or more polymorphisms (e.g., SNPs). Exemplary polymorphisms are disclosed in Table 2. The skilled artisan will appreciate that other polymorphisms are known in the art and may be identified, for example, by querying the Entrez Single Nucleotide Polymorphism database, for example, by searching with a GeneID from Table 1.

TABLE 1

| Target Nucleic Acids | | | | | | |
|---|---|---|---|---|---|---|
| Gene name | Gene ID | Description | Gene aliases | OMIM | RefSeqGene | Chromosome map position |
| CYP21A2 | 1589 | cytochrome P450, family 21, subfamily A, polypeptide 2 | CAH1; CPS1; CA21H; CYP21; CYP21B; P450c21B; MGC150536; MGC150537; CYP21 A2 | 201910 | NG_008337.1 | 6p21.3 |
| ABCC8 | 6833 | ATP-binding cassette, sub-family C (CFTR/MRP), member 8 | HI; SUR; HHF1; MRP8; PHHI; SUR1; ABC36; HRINS; TNDM2; ABCC8 | 600509 | NG_008867.1 | 11p15.1 |
| ATRX | 546 | sub-family C | SHS; XH2; XNP; ATR2; SFM1; RAD54; MRXHF1; RAD54L; ZNF-HX; MGC2094; ATRX | 300032 | NG_008838.1 | Xq13.1-q21.1 |
| ARSA | 410 | (CFTR/MRP), member 8 | MLD; ARSA | 607574 | NG_009260.1 | 22g13.31-qter; 22q13.33 |
| PSAP | 5660 | Prosaposin | GLBA; SAP1; FLJ00245; MGC110993; PSAP | 176801 | NG_008835.1 | 10q21-q22 |
| BTD | 686 | Biotinidase | BTD | 609019 | NG_008019.1 | 3p25 |
| HLCS | 3141 | holocarboxylase synthetase (biotin-(proprionyl-Coenzyme A-carboxylase (ATP-hydrolysing)) ligase) | HCS; HLCS | 609018 | NC_000021.7 | 21q22.1; 21q22.13 |
| BLM | 641 | Bloom syndrome, RecQ helicase-like | BS; RECQ2; RECQL2; RECQL3; MGC126616; MGC131618; MGC131620; BLM | 604610 | NG_007272.1 | 15q26.1 |
| ASPA | 443 | aspartoacylase (Canavan disease) | ASP; ACY2; ASPA | 608034 | NG_008399.1 | 17pter-P13 |
| CFTR | 1080 | cystic fibrosis transmembrane conductance regulator (ATP-binding cassette sub-family C, member 7) | CF; MRP7; ABC35; ABCC7; CFTR/MRP; TNR-CFTR; dJ760C5.1; CFTR | 602421 | NC_000007.12 | 7q31.2 |
| ASS1 | 445 | argininosuccinate synthetase 1 | ASS; CTLN1; ASS1 | 603470 | NG_011542.1 | 9q34.1 |
| MMACHC | 25974 | methylmalonic aciduria (cobalamin deficiency) cb1C type, with homocystinuria | cb1C; FLJ25671; DKFZp564I122; RP11-291L19.3; MMACWC | 609831 | NC_000001.9 | 1p34.1 |
| IKBKAP | 8518 | inhibitor of kappa light polypeptide gene enhancer in B-cells, kinase complex-associated protein | FD; DYS; ELP1; IKAP; IKI3; TOT1; FLJ12497; DKFZp781H1425; IKBKAP | 603722 | NG_008788.1 | 9q31 |
| FANCC | 2176 | Fanconi anemia, complementation group C | FA3; FAC; FACC; FLJ14675; FANCC | 227645 | NG_011707.1 | 9q22.3 |
| GALK1 | 2584 | galactokinase 1 | GK1; GALK; GALK1 | 604313 | NG_008079.1 | 17q24 |
| GALT | 2592 | galactose-l-phosphate uridylyltransferase | GALT | 606999 | NC_000009.10 | 9p13 |

TABLE 1-continued

Target Nucleic Acids

| Gene name | Gene ID | Description | Gene aliases | OMIM | RefSeqGene | Chromosome map position |
|---|---|---|---|---|---|---|
| GALE | 2582 | UDP-galactose-4-epimerase | SDR1E1; FLJ95174; FLJ97302; GALE | 606953 | NG_007068.1 | 1p36-p35 |
| GBA | 2629 | glucosidase, beta; acid (includes glucosylceramidase) | GCB; GBA1; GLUC; GBA | 606463 | NG_009783.1 | 1q21 |
| GJB2 | 2706 | gap junction protein, beta 2, 26 kDa | HID; KID; PPK; CX26; DFNA3; DFNB1; NSRD1; DFNA3A; DFNB1A; GJB2 | 121011 | NG_008358.1 | 13q11-q12 |
| GCDH | 2639 | glutaryl-Coenzyme A dehydrogenase | GCD; ACAD5; GCDH | 608801 | NG_009292.1 | 19p13.2 |
| G6PC | 2538 | glucose-6-phosphatase, catalytic subunit | G6PT; GSD1; GSD1a; MGCI63350; G6PC | 232200 | NG_011808.1 | 17q21 |
| HBB | 3043 | hemoglobin, beta | CD113t-C; beta-globin; HBB | 141900 | NG_000007.3 | 11p15.5 |
| BCKDHA | 593 | branched chain keto acid dehydrogenase E1, alpha polypeptide | MSU; MSUD1; OVD1A; BCKDE1A; FLJ45695; BCKDHA | 608348 | NC_000019.8 | 19q13.1-q13.2 |
| BCKDHB | 594 | branched chain keto acid dehydrogenase E1, beta polypeptide | E1B; FLJ17880; dJ279A18.1; BCKDHB | 248611 | NG_009775.1 | 6q13-q15 |
| DBT | 1629 | dihydrolipoamide branched chain transacylase E2 | E2; E2B; BCATE2; MGC9061; DBT | 248610 | NG_011852.1 | 1p31 |
| DLD | 1738 | dihydrolipoamide dehydrogenase | E3; LAD; DLDH; GCSL; PHE3; DLD | 238331 | NG_008045.1 | 7q31-q32 |
| ACADM | 34 | acyl-Coenzyme A dehydrogenase, C-4 to C-12 straight chain | MCAD; ACAD1; MCADH; FLJ18227; FLJ93013; FLJ99884; ACADM | 607008 | NG_007045.1 | 1p31 |
| MMAA | 166785 | methylmalonic aciduria (cobalamin deficiency) cb1A type | cb1A; MGC120010; MGC120011; MGC120012; MGC120013; MMAA | 607481 | NG_007536.1 | 4q31.22 |
| MMAB | 326625 | methylmalonic aciduria (cobalamin deficiency) cb1B type | ATR; cb1B; MGC20496; MMAB | 607568 | NG_007096.1 | 12q24 |
| MUT | 4594 | methylmalonyl Coenzyme A mutase | MCM; MUT | 609058 | NG_007100.1 | 6p12.3 |
| MCOLN1 | 57192 | mucolipin 1 | ML4; MLIV; MST080; TRPML1; MSTP080; TRP-ML1; TRPM-L1; MCOLN1 | 605248 | NC_000019.8 | 19p13.3-p13.2 |
| ACTA1 | 58 | actin, alpha 1, skeletal muscle | ACTA; ASMA; CFTD; MPFD; NEM1; NEM2; NEM3; CFTD1; CFTDM; ACTA1 | 102610 | NG_006672.1 | 1q42.13 |
| TPM3 | 7170 | tropomyosin 3 | TM3; TRK; NEM1; TM-5; TM30; TM30 nm; TPMsk3; hscp30; MGC3261; FLJ41118; MGC14582; | 191030 | NG_008621.1 | 1q21.2 |

TABLE 1-continued

Target Nucleic Acids

| Gene name | Gene ID | Description | Gene aliases | OMIM | RefSeqGene | Chromosome map position |
|---|---|---|---|---|---|---|
| TNNT1 | 7138 | troponin T type 1 (skeletal, slow) | MGC72094; OK/SW-cl.5; TPM3 ANM; TNT; STNT; TNTS; F1198147; MGC104241; TNNT1 | 191041 | NG_011829.1 | 19q13.4 |
| NEB | 4703 | nebulin | NEM2; NEB177D; FLJ11505; FLJ36536; FLJ39568; FLJ39584; DKFZp686C1456; NEB | 161650 | NG_009382.1 | 2q22 |
| SMPD1 | 6609 | sphingomyelin phosphodiesterase 1, acid lysosomal | ASM; NPD; SMPD1 | 607608 | NG_011780.1 | 11p15.4-p15.1 |
| GLDC | 2731 | glycine dehydrogenase (decarboxylating) | GCE; NKH; GCSP; HYGN1; MGC138198; MGC138200; GLDC | 238300 | NC_000009.10 | 9p22 |
| GCSH | 2653 | glycine cleavage system protein H (aminomethyl carrier) | GCE; NKH; GCSH | 238330 | NC_000016.8 | 16q23.2 |
| AMT | 275 | aminomethyltransferase | GCE; NKH; GCST; AMT | 238310 | NC_000003.10 | 3p21.2-p21.1 |
| OTC | 5009 | ornithine carbamoyltransferase | OCTD; MGC129967; MGC129968; MGC138856; OTC | 300461 | NG_008471.1 | Xp21.1 |
| PAH | 5053 | phenylalanine hydroxylase | PH; PKU; PKU1; PAH | 612349 | NG_008690.1 | 12g22-q24.2 |
| DHPR | 5860 | quinoid dihydropteridine reductase | DHPR; PKU2; SDR33C1; FLJ42391; QDPR | 612676 | NG_008763.1 | 4p15.31 |
| PTS | 5805 | 6-pyruvoyltetrahydropterin synthase | PTPS; FLJ97081; PTS | 261640 | NG_008743.1 | 11q22.3-q23.3 |
| PCCA | 5095 | propionyl Coenzyme A carboxylase, alpha polypeptide | PCCA | 232000 | NG_008768.1 | 13q32 |
| PCCB | 5096 | propionyl Coenzyme A carboxylase, beta polypeptide | DKFZp451E113; PCCB | 232050 | NG_008939.1 | 3q21-q22 |
| ACADS | 35 | acyl-Coenzyme A dehydrogenase, C-2 to C-3 short chain | SCAD; ACAD3; ACADS | 606885 | NG_007991.1 | 12q22-qter |
| DHCR7 | 1717 | 7-dehydrocholesterol reductase | SLOS; DHCR7 | 602858 | NC_000011.8 | 11q13.2-q13.5 |
| SMNT | 6606 | survival of motor neuron 1, telomeric | SMA; SMN; SMA1; SMA2; SMA3; SMA4; SMA @; SMNT; BCD541; T-BCD541; SMN1 | 600354 | NG_008691.1 | 5q13 |
| HEXA | 3073 | hexosaminidase A (alpha polypeptide) | TSD; MGC99608; HEXA | 606869 | NG_009017.1 | 15q23-q24 |
| MYO7A | 4647 | myosin VIIA | DFNB2; MYU7A; NSRD2; USH1B; DFNA11; MYOVIIA; MYO7A | 276903 | NG_009086.1 | 11q13.5 |
| USH1C | 10083 | Usher syndrome 1 C (autosomal recessive, severe) | PDZ73; AIE-75; DFNB18; PDZ-45; PDZ- | 605242 | NC_000011.8 | 11p15.1-p14 |

TABLE 1-continued

Target Nucleic Acids

| Gene name | Gene ID | Description | Gene aliases | OMIM | RefSeqGene | Chromosome map position |
|---|---|---|---|---|---|---|
| CDH23 | 64072 | cadherin-like 23 | 73; NY-CO-37; NY-CO-38; ush1cpst; PDZ-73/NY-CO-38; USH1C USH1D; DFNB12; FLJ00233; FLJ36499; KIAA1774; KIAA1812; MGC102761; DKFZp434P2350; CDH23 | 605516 | NG_008835.1 | 10q21-q22 |
| PCDH15 | 65217 | protocadherin 15 | USH1F; DFNB23; DKFZp667A1711; PCDH15 | 605514 | NG_009191.1 | 10q21.1 |
| SANS | 124590 | Usher syndrome 1G (autosomal recessive) | SANS; ANKS4A; FLJ33924; USH1G | 607696 | NG_007882.1 | 17q25.1 |
| ARX | 170302 | aristaless related homeobox | ISSX; PRTS; MRX29; MRX32; MRX33; MRX36; MRX38; MRX43; MRX54; MRX76; MRX87; MRXS1; ARX | 300382 | NG_008281.1 | Xp21 |
| OPHN1 | 4983 | oligophrenin 1 | OPN1; MRX60; OPHN1 | 300127 | NG_008960.1 | Xq12 |
| JAR1DIC | 8242 | lysine (K)-specific demethylase 5C | MRXJ; SMCX; MRXSJ; XE169; JARID1C; DXS1272E; KDM5C | 314690 | NG_008085.1 | Xp11.22-p11.21 |
| FTSJ1 | 24140 | FtsJ homolog 1 (*E. coli*) | JM23; MRX9; SPB1; TRM7; CDLIV; MRX44; FTSJ1 | 300499 | NG_008879.1 | Xp11.23 |
| SLC6A8 | 6535 | solute carrier family 6 (neurotransmitter transporter, creatine), member 8 | CRT; CT1; CRTR; MGC87396; SLC6A8 | 300036 | NC_000023.9 | Xq28 |
| DLG3 | 1741 | discs, large homolog 3 (*Drosophila*) | MRX; MRX90; NEDLG; NE-Dlg; SAP102; SAP-102; KIAA1232; DLG3 | 300189 | NC_000023.9 | Xq13.1 |
| TM4SF2 | 7102 | tetraspanin 7 | A15; MXS1; CD231; MRX58; CCG-B7; TM4SF2; TALLA-1; TM4SF2b; DXS1692E; TSPAN7 | 300096 | NG_009160.1 | Xp11.4 |
| ZNF41 | 7592 | zinc finger protein 41 | MRX89; MGC8941; ZNF41 | 314995 | NG_008238.1 | Xp11.23 |
| FACL4 | 2182 | acyl-CoA synthetase long-chain family member 4 | ACS4; FACL4; LACS4; MRX63; MRX68; ACSL4 | 300157 | NG_008053.1 | Xq22.3-q23 |
| PQBP1 | 10084 | polyglutamine binding protein 1 | SHS; MRX55; MRXS3; | 300463 | NC_000023.9 | Xp11.23 |

TABLE 1-continued

Target Nucleic Acids

| Gene name | Gene ID | Description | Gene aliases | OMIM | RefSeqGene | Chromosome map position |
|---|---|---|---|---|---|---|
| PEX1 | 5189 | peroxisomal biogenesis factor 1 | MRXS8; NPW38; RENS1; PQBP1 ZWS1; PEX1 | 602136 | NG_008341.1 | 7q21.2 |
| PXMP3 | 5828 | peroxisomal membrane protein 3, 35 kDa | PAF1; PEX2; PMP3; PAF-1; PMP35; RNF72; PXMP3 | 170993 | NG_008371.1 | 8q21.1 |
| PEX6 | 5190 | peroxisomal biogenesis factor 6 | PAF2; PAF-2; PXAAA1; PEX6 | 601498 | NG_008370.1 | 6p21.1 |
| PEX10 | 5192 | peroxisomal biogenesis factor 10 | NALD; RNF69; MGC1998; PEX10 | 602859 | NG_008342.1 | 1p36.32 |
| PEX12 | 5193 | peroxisomal biogenesis factor 12 | PAF-3; PEX12 | 601758 | NG_008447.1 | 17q12 |
| PEX5 | 5830 | peroxisomal biogenesis factor 5 | PXR1; PTS1R; PTS1-BP; FLJ50634; FLJ50721; FLJ51948; PEX5 | 600414 | NG_008448.1 | 12p13.31 |
| PEX26 | 55670 | peroxisomal biogenesis factor 26 | FLJ20695; PEX26M1T; Pex26pM1T; PEX26 | 608666 | NG_008339.1 | 22q11.21 |

The mutations listed in Table 2 are documented polymorphisms in several disease-associated genes (CFTR is mutated in cystic fibrosis, GBA is mutated in Gaucher disease, ASPA is mutated in Canavan disease, HEXA is mutated in Tay Sachs disease). The polymorphisms are of several types: insertion/deletion polymorphisms which will cause frameshifts (and thus generally interrupt protein function) unless the insertion/deletion length is a multiple of 3 bp, and substitutions which can alter the amino acid sequence of the protein and in some cases cause complete inactivation by introduction of a stop codon.

TABLE 2

Non-Limiting Examples of Polymorphism

| Gene name | GeneID | SNP ID | Mutation | SEQ ID NO: |
|---|---|---|---|---|
| CFTR | 1080 | rs63500661 | TCACATCACCAAGTTAAAAAAAAAAA[A/G]GGGGCGGGGGGGCAGAATGAAAATT | 1 |
| CFTR | 1080 | rs63107760 | AAACAAGGATGAATTAAGTTTTTTTT[-/T]AAAAAAGAAACATTTGGTAAGGGGA | 2 |
| CFTR | 1080 | rs62469443 | ATCACCAAGTTAAAAAAAAAAAGGG[A/G]CGGGGGGGCAGAATGAAAATTGCAT | 3 |
| CFTR | 1080 | rs62469442 | CTATTGAACCAGAACCAAACAGGAAT[A/G]CCATAGCATTTTGTAAACTAAACTG | 4 |
| CFTR | 1080 | rs62469441 | CAGGAGTTCAAGACCAGCCTACTAAA[A/C]CACACACACACACACACACACAC | 5 |
| CFTR | 1080 | rs62469439 | GATTAAATAATAGTGTTTATGTACCC[C/G]GCTTATAGGAGAAGAGGGTGTGTGT | 6 |
| CFTR | 1080 | rs62469438 | ATTGTTATCTTTTCATATAAGGTAAC[A/T]GAGGCCCAGAGAGATTAAATAACAT | 7 |
| CFTR | 1080 | rs62469437 | TAATTTTAATTAAGTAAATTTAATTG[A/G]TAGATAAATAAGTAGATAAAAAATA | 8 |
| CFTR | 1080 | rs62469436 | GTATAAAAAAAAAAAAAAAAAAGTT[A/T]GAATGTTTTCTTGCATTCAGAGCCT | 9 |

TABLE 2-continued

Non-Limiting Examples of Polymorphism

| Gene name | GeneID | SNP ID | Mutation | SEQ ID NO: |
|---|---|---|---|---|
| CFTR | 1080 | rs62469435 | ATACTAAAAATTTAAAGTTCTCTTGC[A/G]ATATATTTTCTTAATATCTTACATC | 10 |
| CFTR | 1080 | rs62469434 | TGCTGGGATTACAGGCGTGAGCCACC[A/G]CGCCTGGCCTGATGGGACATATTTT | 11 |
| CFTR | 1080 | rs62469433 | CTACAATATAAGTATAGTATTGCAAA[A/C]CCATCAGGAAGGGTGTTAACTATTT | 12 |
| CFTR | 1080 | rs61763210 | GTTGTCTCCAAACTTTTTTTCAGGTG[-/AGA]AGGTGGCCAACCGAGCTTCGGAAAG | 13 |
| CFTR | 1080 | rs61720488 | TTTTTTCATAAAAGATTATATAAAGG[A/C]TATTGCTTTTGAATCACAAACACTA | 14 |
| CFTR | 1080 | rs61481156 | ATCTAGTGAGCAGTCAGGAAAGAGAA[C/T]TTCCAGATCCTGGAAATCAGGGTTA | 15 |
| CFTR | 1080 | rs61443875 | TAGAGTATAAAAAAAAAAAAAAAAA[-/A]GTTTGAATGTTTTCTTGCATTCAGA | 16 |
| CFTR | 1080 | rs61312222 | TGCAAATGCCAACTATCAAAGATATT[C/G]GAGTATACTGTCAATAAACTTCATA | 17 |
| CFTR | 1080 | rs61159372 | TCCTCAACAGTTAGAAACAATATTTT[C/G]AGTGATTTCCCATGCCAACTTTACT | 18 |
| CFTR | 1080 | rs61094145 | TTTTTGGTATTGTTGTTAAATAAGTG[A/G]GAATTCAATACAGTATAATGTCTGT | 19 |
| CFTR | 1080 | rs61086387 | CTTGAAATCGGATATATATATATATA[-/TGTATATATATATATATATATATATATACATATATATATATA]GTATTATCCCTGTTTTCACAGTTTT | 20 |
| CFTR | 1080 | rs60996744 | AGAGGGGCTGTGAAGGACACCAAGGA[A/G]GAGACTAAGAGCCAGGAGGGAAAAC | 21 |
| CFTR | 1080 | rs60960860 | TAGAGTTTATTAGCTTTTACTACTCT[A/G]CTTAGTTACTTTGTGTTACAGAATA | 22 |
| CFTR | 1080 | rs60923902 | ACTAGTGATGATGAGCTTCTTTTCAT[-/AT]GTTTGTTGGCTGCATAAATGTCTTC | 23 |
| CFTR | 1080 | rs60912824 | GCAGAGAAAAGAGGGGCTGTGAAGGA[C/G]ACCAAGGAGGAGACTAAGAGCCAGG | 24 |
| CFTR | 1080 | rs60887846 | TTCAGAGGTCTACCACTGGTGCATAC[G/T]CTAATCACAGTGTCGAAAATTTTAC | 25 |
| CFTR | 1080 | rs60793174 | AAGAAAGAGCAAAAGAGGGCAAACTT[C/T]TCATACATTTTTGATGTCGAAACCA | 26 |
| CFTR | 1080 | rs60788575 | CCTAAAGTTTAAAAAGAAAAAAAAAA[-/A]GGAAGAAGGAATTAAAAATCCAAAG | 27 |
| CFTR | 1080 | rs60760741 | GTGTGTGTGTGTATATATATATATAT[A/T]TATATATTTTTTTTTCCTGAGCCA | 28 |
| CFTR | 1080 | rs60456599 | AAACTGTTGATGTTTTCATTTATTTA[C/G]ATCATTGGAAAACTTTAGATTCTAG | 29 |
| CFTR | 1080 | rs60363249 | TTTATCCATTCTTAACCAGAACAGAC[A/G]TTTTTTCAGAGCTGGTCCAGGAAAA | 30 |
| CFTR | 1080 | rs60355115 | TTGAAATCGGATATATATATATATAT[A/G]TATATATATATATATATATATAT | 31 |
| CFTR | 1080 | rs60308689 | TAGTTTTTTATTTCCTCATATTATTT[-/T]CAGTGGCTTTTTCTTCCACATCTTT | 32 |
| CFTR | 1080 | rs60271242 | ACATAGTTCTCAGTGGTACAACTACA[A/G]GTGATTTCTCTTTTCTTATTTCTGG | 33 |

TABLE 2-continued

Non-Limiting Examples of Polymorphism

| Gene name | GeneID | SNP ID | Mutation | SEQ ID NO: |
|---|---|---|---|---|
| CFTR | 1080 | rs60010318 | AGAGCAATGGCATCCCTTGTCTTGTG[C/T]TATACAGGATGCAGCAATTTATAGG | 34 |
| CFTR | 1080 | rs59961323 | TTCTGTCTACATAAGATGTCATACTA[A/G]ATTATCTTTTCCAGCATGCATTCAG | 35 |
| CFTR | 1080 | rs59961270 | CAGGGTGGCATGTTAGGCAGTGCTTA[A/G]AATAAATGAGTTGGTTATACAAGTA | 36 |
| CFTR | 1080 | rs59837506 | AGGACACACACACACACACACACACA[-/CA]TGCACACACATTTAAATAGATGCAT | 37 |
| CFTR | 1080 | rs59572090 | TAAAAAATTGGTATAATGAAATTGCA[C/T]TTGTAGTCTTTGGACATTTAAATCC | 38 |
| CFTR | 1080 | rs59548252 | TTTCAATACTTAAGAGGTACGCAGAG[A/G]AAAGAGGGGCTGTGAAGGACACCAA | 39 |
| CFTR | 1080 | rs59519859 | CAGCAATGAATATTTTGAGGCTGAGG[C/T]GCTGAGGGGTAAAATTGCAGCCTGG | 40 |
| CFTR | 1080 | rs59509837 | TTATGGTTTATATTTTGTGTCTTCT[-/CTTT]AACACATCTTTTCTAGCAGAATTCA | 41 |
| CFTR | 1080 | rs59417037 | GTATTTTAGTTTTTTTTTTTGTTTG[-/T]TTTGTTTTGTTTTGTTTTGTTTTG | 42 |
| CFTR | 1080 | rs59159458 | TGGGTGACTCCATTTTTACTTTTAGT[C/T]TGGTCTGTTGAGGCCTCGTGAGAGA | 43 |
| CFTR | 1080 | rs59048119 | TATTTTCATGTATTTTAGTTTTTTTTT[-/TTTT]GTTTGTTTTGTTTTGTTTTGTTTTG | 44 |
| CFTR | 1080 | rs58970500 | GTGTGTGTGTATATATATATATATAT[A/T]TATATTTTTTTTTCCTGAGCCAAA | 45 |
| CFTR | 1080 | rs58942292 | AACCTATTAGCATGTCTGGCAGAAAA[-/A]TAGATACTTAATAAATTTCTTAAAT | 46 |
| CFTR | 1080 | rs58917054 | GAGGCTTAGACAGTTTAAGTAACTCA[A/G]GCATGGTTACACAACTAGCTAGGGC | 47 |
| CFTR | 1080 | rs58837484 | GTGTGAGTATTATGAGACCATATGTT[A/G]GGAGATTTTATTTGGTATTGAGGAT | 48 |
| CFTR | 1080 | rs58829491 | GAAACCCCACCCCTTCTATAGTTTTC[C/T]CTTTAATATTTACAATGGAACCATT | 49 |
| CFTR | 1080 | rs58805195 | CATATATATATAGTGTGTGTGTGT[A/G]TATATATATATATATATATTTTT | 50 |
| GBA | 2629 | rs60866785 | CGAGCGAGAGAGAGAGAGAGAGAGAG[-/AG]GAGCCGGCGCGAGAACTACGCATGC | 51 |
| GBA | 2629 | rs60239603 | GGCAGGTAATATCTAGTACCTTACTT[A/T]TATTTCCTGAGCACATTCTACATTT | 52 |
| GBA | 2629 | rs56310840 | GGCCAGGAATGGGAGTGCTTAGGTGC[A/G]GAGGTGGCACTGTTCCCGCAGCTGC | 53 |
| GBA | 2629 | rs41264927 | GAAAACTCCATCCCCTCAGGGTCAT[C/T]AGATGAAGAAGACCACAGGGGTT | 54 |
| GBA | 2629 | rs41264925 | TGTAGGTAAGGGTCACATGTGGGAGA[C/G]GCAGCTGTGGGTAGGTCAGCCCTGT | 55 |
| GBA | 2629 | rs36024691 | CCAAGAAGGCGCCATTACACTCCAGC[-/C]TGGGCGACAGGGCGAGACTCCCTCA | 56 |
| GBA | 2629 | rs36024092 | TGCCACACACCCAGCTAATTTGTGTGTG[-/G]TATGTGTGTGTATGTATGTGTGTGT | 57 |

TABLE 2-continued

Non-Limiting Examples of Polymorphism

| Gene name | GeneID | SNP ID | Mutation | SEQ ID NO: |
|---|---|---|---|---|
| GBA | 2629 | rs35682967 | GTTCCTCCAGTAATTTTTTTTTTTT[-/T]GGTTTTGAGACAGAGTCTTGCCCTG | 58 |
| GBA | 2629 | rs35033592 | ATCATGCCCAGATAATTTTTTTTTT[-/T]GTATTTTAGTAGACACAGGGTTTCA | 59 |
| GBA | 2629 | rs34732744 | CGAGCGAGAGAGAGAGAGAGAGAG[-/AG]GAGCCGGCGCGAGAACTACGCATGC | 60 |
| GBA | 2629 | rs34620635 | CCTGTGAGGGGCACATTCCTTAGTAG[-/C]TAAGGAGTTGGGGGTGTGAAGATCC | 61 |
| GBA | 2629 | rs34302637 | ACAGGCTACTGGCTGGGCCCAGGCAA[-/A]GGGGGCCTTGGCAGGAAAAGTTCCT | 62 |
| GBA | 2629 | rs33949225 | GCGAGAGAGAGAGAGAGAGAGAGG[-/AG]AGCCGGCGCGAGAACTACGCATGCG | 63 |
| GBA | 2629 | rs28678003 | AAGAAGAAAAATAAAAAGAAAGTGGG[C/T]CAGACCGAGAGAACAGGAAGCCTGA | 64 |
| GBA | 2629 | rs28559737 | AAGGACAAAGGCAAAGAGACAAAGGC[G/T]CAACACTGGGGGTCCCCAGAGAGTG | 65 |
| GBA | 2629 | rs28373017 | TACCTAGTCACTTCCTGCCTCCATGG[C/T]GCAAAAGGGGATGGGTGTGCCTCTT | 66 |
| GBA | 2629 | rs12752133 | CTCTTCCGAGGTTCCACCCTGAACAC[C/T]TTCCTGCTCCCTCGTGGTGTAGAGT | 67 |
| GBA | 2629 | rs12747811 | TTCTGACTGGCAACCAGCCCCACTCT[C/T]TGGGAGCCCTCAGGAATGAACTTGC | 68 |
| GBA | 2629 | rs12743554 | gctcagcctcccaggctggagtgcag[A/T]ggcgcgatctcggctcaccgcaacc | 69 |
| GBA | 2629 | rs12041778 | CATGAACCACATCAAATGAGATTTAG[C/T]GGGAGTGGCACACACAGTCATGACC | 70 |
| GBA | 2629 | rs12034326 | AAGCAGCCCTGGGGAGTCGGGGCGGG[A/G]CCTGGATTGGAAAAGAGACGGTCAC | 71 |
| GBA | 2629 | rs11558184 | CTCCAAGTTCTGGGAGCAGAGTGTGC[A/G]GCTAGGCTCCTGGGATCGAGGGATG | 72 |
| GBA | 2629 | rs11430678 | GTTCCTCCAGTAAttttttttttttt[-/G/T]gttttgagacagagtcttgccctgt | 73 |
| GBA | 2629 | rs11264345 | CTAGTACCTTACTTCCCTCAAGTTCA[A/T]TCATCTCACAGATATTTCCTGAGCA | 74 |
| GBA | 2629 | rs10908459 | aattagccgtgcgtggtggcgggtgc[C/T]tgtaatcccacgtacttgggaggct | 75 |
| GBA | 2629 | rs10796940 | CCATGGCCAGCCGGGGAGGGGACGGG[A/C]ACACACAGACCCACACAGAGACTCA | 76 |
| GBA | 2629 | rs10668496 | agcgagagagagagagagagagagag[-/AG]gagCCGGCGCGAGAACTACGCATGC | 77 |
| GBA | 2629 | rs7416991 | CGTAGCAGTTAGCAGATGATAGGCGG[C/G/T]GAAATCTTATTTCACAGGGCATTAA | 78 |
| GBA | 2629 | rs4024049 | CTGGCCCTGGTGACAGTGGGGCTGTG[C/T]GTGGGGCCAGAGCCTTCTCAGAGGT | 79 |
| GBA | 2629 | rs 4024048 | CAGATACTGGCCCTGGTGACAGTGGG[A/G]CTGTGCGTGGGGCCAGAGCCTTCTC | 80 |
| GBA | 2629 | rs 4024047 | GACAGATACTGGCCCTGGTGACAGTG[G/T]GGCTGTGCGTGGGGCCAGAGCCTTC | 81 |

TABLE 2-continued

Non-Limiting Examples of Polymorphism

| Gene name | GeneID | SNP ID | Mutation | SEQ ID NO: |
|---|---|---|---|---|
| GBA | 2629 | rs3841430 | GGCTCctctctctctctctctctctc[-/TC]gctcgctctctcgctctctcgctct | 82 |
| GBA | 2629 | rs3754485 | GTTTCAGACCAGCCTGGCCAACATAG[C/T]GAAACCCCATCTCTACTAAAAATAA | 83 |
| GBA | 2629 | rs3205619 | AGTGGGCGATTGGATGGAGCTGAGTA[C/T]GGGGCCCATCCAGGCTAATCACACC | 84 |
| GBA | 2629 | rs2990227 | CCGGGCTCCGTGAATGTTTGTCACAT[C/G]TCTGAAGAACGTATGAATTACATAA | 85 |
| GBA | 2629 | rs2990226 | GAATCCCAACCCCGACGCTCGTCGCC[C/G]GGCTCCGTGAATGTTTGTCACATGT | 86 |
| GBA | 2629 | rs2990225 | GCGAATCCCAACCCCGACGCTCGTCG[C/T]CGGGCTCCGTGAATGTTTGTCACAT | 87 |
| GBA | 2629 | rs2990224 | TGGGCAGAAGTCAGGGTCCAAAGAAA[G/T]GGCAAAGAAAAGTGTcagtggctca | 88 |
| ASPA | 443 | rs63751297 | TAAGAAAGACGTTTTTGATTTTTTTC[A/G]GACTTCTCTGGCTCCACTACCCTGC | 89 |
| ASPA | 443 | rs62071301 | CTGATTCCTGGCCAGGAGCGGTGGCT[C/T]ACGCCTGTAATCCCAGCGCTTTGGG | 90 |
| ASPA | 443 | rs62071300 | TAAAAATGCTGATTCCTGGCCAGGAG[C/T]GGTGGCTCACGCCTGTAATCCCAGC | 91 |
| ASPA | 443 | rs62071299 | TTTAAAAATGCTGATTCCTGGCCAGG[A/C]GCGGTGGCTCACGCCTGTAATCCCA | 92 |
| ASPA | 443 | rs62071297 | CAAGACCTGTCAAAGATCTGAGAAAT[A/T]TTACCCGACTTACAAGCTAACCATT | 93 |
| ASPA | 443 | rs61697033 | ACTGTAATAAGTGCTGTAAAAGAAAT[A/G]CACAAAATAATATAGCAGAGGGTAT | 94 |
| ASPA | 443 | rs60743592 | CTTGAGGTCAGGAGTTCAAGACCAGT[C/T]TGGGCAACATGGGAAAACCTTGTC | 95 |
| ASPA | 443 | rs60666840 | AGGTTGCAGTGAGCCGAGATCATGCC[A/G]TTGCACTCCAGCCGGGGCAACAAAA | 96 |
| ASPA | 443 | rs60147514 | ACAAGTGTCTTGAAATTATCTGTGAT[C/T]TGCTATAGAGCAATACTTTTGTAAA | 97 |
| ASPA | 443 | rs59930743 | GTGGGTATATGCAGCTCTATGCACTA[C/T]CTGCTCATTTATTTGGTAAATCTAA | 98 |
| ASPA | 443 | rs59690349 | TGTGTGTGTGTGCGTGTGTGTGTGTG[-/TGTGTGTG]ATCATAAGAGTGGCTGCAGCAAACT | 99 |
| ASPA | 443 | rs59676360 | AGTCTGGAGTGCAATGGTGCAATCTC[A/G]GCTCACTGCAGCCTCCACCTCCGGG | 100 |
| ASPA | 443 | rs59335404 | CTCCTAATGGATATTTCCTAAATTTT[G/T]CTGAACAGAATTTAACTTGAGCTGG | 101 |
| ASPA | 443 | rs58879097 | ATTTAAAAATGGATTTCTAGAAAAAC[A/G]ATCACATACTTGAATATTTTAGCAA | 102 |
| ASPA | 443 | rs58686774 | CTATAAATGGGTAGCATGAGGGATTC[A/G]AGGAGGTGGCTGAAAGAAGCACGTA | 103 |
| ASPA | 443 | rs57511162 | AAGAAACCAAGCATAGTAGAGTGTTA[A/G]AAAACCAAAGCAACTAAACAACTGT | 104 |
| ASPA | 443 | rs55859596 | CGGGGCTCAGAACTTGTAACAGAAAA[A/T]TAAAATATACTCCACTCAAGGGAAT | 105 |

TABLE 2-continued

Non-Limiting Examples of Polymorphism

| Gene name | GeneID | SNP ID | Mutation | SEQ ID NO: |
|---|---|---|---|---|
| ASPA | 443 | rs55742972 | TACTACACTTCACGGATACTGTACTT[-/GTACTT]TTTTTCCAAATTGAAGGTTTTTGGC | 106 |
| ASPA | 443 | rs55640436 | TTGTTTTTGTTTTTGTTTTTGTTTTT[-/GTTTTTGTTTTT]TGAGATGGAGTCTCGCTCTGTCGCC | 107 |
| ASPA | 443 | rs36225687 | TTTGCCTTACTACACTTCACGGATAC[-/TGTACT]TGTACTTTTTTTCCAAATTGAAGGT | 108 |
| ASPA | 443 | rs36051310 | GAGGTGGCTGAAAGAAGCACGTATCC[-/C]TGATGGCATGGTTGCGGGTTATATG | 109 |
| ASPA | 443 | rs36034906 | GAGAAAAGCAGTTCCTGGAACACCCC[-/C]ACCCCTTAACCCCTTATCTCTGCTT | 110 |
| ASPA | 443 | rs36033666 | TTACATATGTATACATGTGCCATGTT[-/T]GGTGTGCCGCACCCATTAACTCGTC | 111 |
| ASPA | 443 | rs35730123 | CTTTTTCCAGATTTTTTTTTTTTTT[-/T]GAGACAGAGTTTCACTCTTGTTGCC | 112 |
| ASPA | 443 | rs35629100 | TTTGGAAATCTTAAGCTTTTATTTGG[-/G]TGTCACAGAGAAACAGGATCTGTAT | 113 |
| ASPA | 443 | rs35614631 | TACTTTAAGTTTTAGGGTACATGTGC[-/A]CCATGTGCAGGTTTGTTACATATGT | 114 |
| ASPA | 443 | rs35225782 | ATTCATGACCAGCCACATAAATGCAC[-/A]GTATTACTTCGCAAGCATGCCAATG | 115 |
| ASPA | 443 | rs35178659 | GTGCACTAGAATTAGCTAAAGTGGGG[-/G]AAAAAAGATGCATTTGATGGTCTA | 116 |
| ASPA | 443 | rs35095578 | AACCTCCACCTCCCAGGTTCAAGAGA[-/A]TTCTCCTGCCTCAGCCTCCCAAGTA | 117 |
| ASPA | 443 | rs35002210 | CCTCCCTGTGATCCGAAGTAGCAGAC[A/G]TACTTAACTTCCATGGTGGATTGTT | 118 |
| ASPA | 443 | rs34744839 | AAAACATTATTATATCTAGAAAAAAA[-/A]TGTATCTTAACCATTGTGGGAAGTG | 119 |
| ASPA | 443 | rs34680506 | TTGAAGGTAAAATCATAGGGAGTTGG[-/G]AGCTGTCCTCTTGCGCTGAATCAGT | 120 |
| ASPA | 443 | rs34365618 | ACTTGTGGCCTTTTTGGAGAGGTTAG[-/CA]ACTCTGAAAACTCTGTCCCTGGACC | 121 |
| ASPA | 443 | rs34275920 | GAAGGAGAAAAAGAGAGGAAATAAGT[-/T]AAAATAATAAACACAATTAATAAAG | 122 |
| ASPA | 443 | rs34109510 | TGTATACATGTGCCATGTTGGTGTGC[C/T]GCACCCATTAACTCGTCATTTAGCA | 123 |
| ASPA | 443 | rs34054576 | TCACCTGTCACCTCCTATAGAACTTT[-/C]CCCTGACCCTCCTCTATAGCATTAA | 124 |
| ASPA | 443 | rs34015272 | ATAAATGATCATCATTCACAGTAGGG[-/G]TTTTGTTTTGTTTTTTTCTGGAAA | 125 |
| ASPA | 443 | rs34002091 | ACAGACATATCTACAAACACACTTTT[-/T]CACATATTTGTGTAAGTCATTTATG | 126 |
| ASPA | 443 | rs28940574 | AAAGACAACTAAACTAACGCTCAATG[A/C]AAAAGTATTCGCTGCTGTTTACAT | 127 |
| ASPA | 443 | rs28940279 | TACCGTGTACCCCGTGTTTGTGAATG[A/C]GGCCGCATATTACGAAAAGAAAGAA | 128 |

TABLE 2-continued

Non-Limiting Examples of Polymorphism

| Gene name | GeneID | SNP ID | Mutation | SEQ ID NO: |
|---|---|---|---|---|
| ASPA | 443 | rs17850703 | CAGGGCTGGAGGTAAAACCATTTATT[A/G]CTAACCCCAGAGCAGTGAAGAAGTG | 129 |
| ASPA | 443 | rs17222495 | TTCTTCATTGCCTATTGAAGAGAGAG[C/T]GGAATGCTTTGGTTGCCAGATATGG | 130 |
| ASPA | 443 | rs17175228 | CACAAGATCTCATTACTCAGGAGCTG[C/T]CCAAGTGTCTAATGTACTTAGTTAA | 131 |
| ASPA | 443 | rs16953074 | TTCTGTGTAACATTTCATTTAAGCAA[A/G]GGATTCGGCAAATCAAAAATTGTCA | 132 |
| ASPA | 443 | rs16953070 | TAAAACGTATTGAAGGTATTATTGAC[G/T]CTGTTGAAGCAAAGAGAACAAAACA | 133 |
| HEXA | 3073 | rs62022858 | ATCTGCTCTTCCAGTTGGATGACAAG[C/T]CTTGCTGTCTAACACCTGCTGCAGA | 134 |
| HEXA | 3073 | rs62022857 | CCATTTTTTGTTGTATTTTTTTTTTC[C/T]TGAATACTTTTATCGCAGTTGGTT | 135 |
| HEXA | 3073 | rs62017872 | CCCTGTCTCTAAAAGAAAAAAAAAAA[A/G]AAAAAAAAAGAAAACAAAACCCAA | 136 |
| HEXA | 3073 | rs62017871 | AGTGGCTCCAAAAAGGTCATGGAACC[C/T]CTTGAGGATGATGCAAATTGACTCT | 137 |
| HEXA | 3073 | rs61662730 | TAAAGTTACTTTTCTTTTATTGACTT[C/T]CCCTTATTTTTTAACCTTATGCTTT | 138 |
| HEXA | 3073 | rs61329913 | CAGAGTTAAAAAAAAAAAAAAAAAA[-/A]GGAAGTAGCAGCAACAGCTTGGAAA | 139 |
| HEXA | 3073 | rs60920713 | GTTGCCCAGGGTTGAGTGCAGAGGCA[C/T]ATTTGGCTCACAGCAACCTCTGCC | 140 |
| HEXA | 3073 | rs60783213 | AAGGCTTTTTTTTTTTTTTTTTTT[-/TTTT]GAGACAGAGTCTTGCTGTGTCACCC | 141 |
| HEXA | 3073 | rs60644867 | GCCTACATTCTGCAAAGAGGAGGGAA[C/G]ATTCACAGCTCCATACTTGAACCCT | 142 |
| HEXA | 3073 | rs60288568 | CCAAAGGAGAATAGCTCTAGGGGAGG[C/G]AGGTGGATGAGTATGCATGGGGAG | 143 |
| HEXA | 3073 | rs59888548 | GACTCCATCTCAAAAAAAAAAAAAA[-/A]TGCAGTCTAATGGCAGAATTAGACT | 144 |
| HEXA | 3073 | rs59733856 | TTATTTATTTATTTATTTATTTTTGA[A/G]ACAGGGTCTCTGTTGTCCAGGCTGG | 145 |
| HEXA | 3073 | rs59427837 | TTTTGAGGCAGGGTCTCACTCTGTTG[C/T]CCAGGGTTGAGTGCAGAGGCACATC | 146 |
| HEXA | 3073 | rs59171976 | CGCCTTGCGAAGGCCCCACAGCTTGC[C/T]TGTGACAAACGTTCATAGGCAAATG | 147 |
| HEXA | 3073 | rs58706602 | GGAGGTCTGTACAAAGCACCACCTAC[C/T]TCATGGGTCAGTTTCCACAGCAGAA | 148 |
| HEXA | 3073 | rs58696963 | GAATCTTATAATTCACTGTGTACCTC[-/CTC]TGTTTCATATTTTCGCAATTGAACT | 149 |
| HEXA | 3073 | rs58610850 | AACATAGTATCTAATATAGCTTTACA[C/T]CCAAAGCCAAAATATGAATACACTG | 150 |
| HEXA | 3073 | rs58016062 | TTGTTTTGTTTTGTTTGGGGGGGGGG[-/G]TTGTTTTTCTGAGAGGGAGTCTTGC | 151 |
| HEXA | 3073 | rs57733983 | CATACCAAAGGGCAGCTGGAGGGATAC[C/T]AGACGGAAGTCATGTGGAGAGTGAA | 152 |

TABLE 2-continued

Non-Limiting Examples of Polymorphism

| Gene name | GeneID | SNP ID | Mutation | SEQ ID NO: |
|---|---|---|---|---|
| HEXA | 3073 | rs57476645 | CAGGTGTGAGCCACCACGACCACCAA[A/T]TTAGCTCTTTTTACTCCTTCCCTTC | 153 |
| HEXA | 3073 | rs56870003 | AGTGGTAGCTGATTTTGCTTCTGGAT[A/C]CTTTGCCACCTTCCCACTCTTTAAT | 154 |
| HEXA | 3073 | rs56338339 | AAAGACCTGTTTCTTAAAAAAAAAAA[-/AGAAAAAAAAAAA]GAAAGAAAAGAAAAGAAAAAACAG | 155 |
| HEXA | 3073 | rs55995352 | TAAAAAATCTTTCAATGAGGAGATGT[C/T]CCCAGAGCAAGACAGCTGTAGGATG | 156 |
| HEXA | 3073 | rs55860138 | AAAAGAAAAAAAAAAAAAAAAAAAAA[-/A]GAAAACAAAACCCAAACCCATAAAG | 157 |
| HEXA | 3073 | rs55743646 | CCTGTCTCTAAAAGAAAAAAAAAAAA[A/G]AAAAAAAAGAAAACAAAACCCAAA | 158 |
| HEXA | 3073 | rs55665666 | GTTATCATAGAAAAATATCACACTCT[-/GT]CTGTATCCCCACTTCCAGAAACTGT | 159 |
| HEXA | 3073 | rs36106892 | CAGGAGCTCATAGAATTACATACAAT[-/C]TTTTTTTTTTTTTTTGAGACAGCG | 160 |
| HEXA | 3073 | rs36091525 | TTGAGAATCTTATAATTCACTGTGTA[-/CCTC]CCTCTGTTTCATATTTTCGCAATTG | 161 |
| HEXA | 3073 | rs35949555 | CCACTACCACAGTGCCTAGAGAACAA[C/T]ATGTGTTTAATAATATTTAAATAAT | 162 |
| HEXA | 3073 | rs35827424 | CCCTGTCTCTAAAAGAAAAAAAAAAA[-/A]AAAAAAAAAAGAAAACAAAACCCAA | 163 |
| HEXA | 3073 | rs35729578 | CCATTATATCATTCATTTCCCACTCA[-/T]TTTCTTCATTCCAACCAAGATATAT | 164 |
| HEXA | 3073 | rs35649102 | TCCGTCTCAAAAAAAAAAAAAAAAAG[-/A]GAAAGGAATTATTCTCATGTATACA | 165 |
| HEXA | 3073 | rs35118677 | CTGGGGCAGTTAAAAAGAAAAACAAA[-/C]CCCTGGTCCCTGCCCTTGAGGAGAT | 166 |
| HEXA | 3073 | rs35005352 | CTCCAGGGTCCCATTCCAGGACCACA[-/C]GCCTGCTACCTCTGCAGCTCACTCA | 167 |
| HEXA | 3073 | rs34736306 | GGATTGACATATACCAGTTAGACGGA[-/T]TTTTTTTTTCCATAAACCAGGCTCA | 168 |
| HEXA | 3073 | rs34607939 | ACAAATAATTACTACATATCTACAAC[A/G]TTCCAGATACAGAAGAAATGGCCAA | 169 |
| HEXA | 3073 | rs34496117 | TAAACACACTTGAAACATCATATAAA[-/ATG]ATATTACTACAAGACTTAACCGTAA | 170 |
| HEXA | 3073 | rs34300017 | ACACAGGTAATCCATGTTTATTATAG[-/A]AAAATGCCACATTACTCTTTATTGA | 171 |
| HEXA | 3073 | rs34206496 | AGTTATCATAGAAAAATATCACACTC[-/TG]TCTGTATCCCCACTTCCAGAAACTG | 172 |
| HEXA | 3073 | rs34110830 | AATGAACTTACAGGAAGGTAATATAT[-/G]GGAAATAAACATCTTATTGAATTTA | 173 |
| HEXA | 3073 | rs34093438 | GGACCCCTGAAAGGCACAAGACACCC[-/T]TTCAGGTTCACACTTCCTGAAAGCT | 174 |
| HEXA | 3073 | rs34085965 | CCACCAATCACCAGAGCCTTCTGCTC[A/G]GGGGTACCTGAGGGAAAACAAGCAA | 175 |
| HEXA | 3073 | rs34004907 | AAAGACTGAAAAAACATTCATAACTA[-/T]TTTTCTTGTTATCCTCGGAAATGTC | 176 |

TABLE 2-continued

Non-Limiting Examples of Polymorphism

| Gene name | GeneID | SNP ID | Mutation | SEQ ID NO: |
|---|---|---|---|---|
| HEXA | 3073 | rs28942072 | TATCTTCATCTTGGAGGAGATGAGGT[C/T]GATTTCACCTGCTGGAAGTCCAACC | 177 |
| HEXA | 3073 | rs28942071 | TTGCCTATGAACGTTTGTCACACTTC[C/T]GCTGTGAGTTGCTGAGGCGAGGTGT | 178 |
| HEXA | 3073 | rs28941771 | GCTTGCTGTTGGATACATCTCGCCAT[C/T]ACCTGCCACTCTCTAGCATCCTGGA | 179 |
| HEXA | 3073 | rs28941770 | CCGGGGCTTGCTGTTGGATACATCTC[G/T]CCATTACCTGCCACTCTCTAGCATC | 180 |

3. Nucleic Acid Target Length Evaluation:

In some embodiments, aspects of the invention relate to methods for detecting nucleic acid deletions or insertions in regions containing nucleic acid sequence repeats.

Genomic regions that contain nucleic acid sequence repeats are often the site of genetic instability due to the amplification or contraction of the number of sequence repeats (e.g., the insertion or deletion of one or more units of the repeated sequence). Instability in the length of genomic regions that contain high numbers of repeat sequences has been associated with a number of hereditary and non hereditary diseases and conditions.

For example, "Fragile X syndrome, or Martin-Bell syndrome, is a genetic syndrome which results in a spectrum of characteristic physical, intellectual, emotional and behavioral features which range from severe to mild in manifestation. The syndrome is associated with the expansion of a single trinucleotide gene sequence (CGG) on the X chromosome, and results in a failure to express the FMR-1 protein which is required for normal neural development. There are four generally accepted forms of Fragile X syndrome which relate to the length of the repeated CGG sequence; Normal (29-31 CGG repeats) (SEQ ID NO: 6375), Premutation (55-200 CGG repeats) (SEQ ID NO: 6376), Full Mutation (more than 200 CGG repeats) (SEQ ID NO: 6377), and Intermediate or Gray Zone Alleles (40-60 repeats) (SEQ ID NO: 6378)."

Other examples include cancer, which has been associated with microsatellite instability (MSI) involving an increase or decrease in the genomic copy number of nucleic acid repeats at one or more microsatellite loci (e.g., BAT-25 and/or BAT-26). There are currently many sequencing-based assays for determining the number of nucleic acid sequence repeats at a particular locus and identifying the presence of nucleic acid insertions or deletions. However, such techniques are not useful in a high throughput multiplex analysis where the entire length of a region may not be sequenced.

In contrast, in some embodiments, aspects of the invention relate to detecting the presence of an insertion or deletion at a genomic locus without requiring the locus to be sequenced (or without requiring the entire locus to be sequenced). Aspects of the invention are particularly useful for detecting an insertion or deletion in a nucleic acid region that contains high levels of sequence repeats. The presence of sequence repeats at a genetic locus is often associated with relatively high levels of polymorphism in a population due to insertions or deletions of one or more of the sequence repeats at the locus. The polymorphisms can be associated with diseases or predisposition to diseases (e.g., certain polymorphic alleles are recessive alleles associated with a disease or condition). However, the presence of sequence repeats often complicates the analysis of a genetic locus and increases the risk of errors when using sequencing techniques to determine the precise sequence and number of repeats at that locus.

In some embodiments, aspects of the invention relate to determining the size of a genetic locus by evaluating the capture frequency of a portion of that locus suspected of containing an insertion or deletion (e.g., due to the presence of sequence repeats) using a nucleic acid capture technique (e.g., a nucleic acid sequence capture technique based on molecular inversion probe technology). According to aspects of the invention, a statistically significant difference in capture efficiency for a genetic locus of interest in different biological samples (e.g., from different subjects) is indicative of different relative lengths in those samples. It should be appreciated that the length differences may be at one or both alleles of the genetic locus. Accordingly, aspects of the invention may be used to identify polymorphisms regardless of whether biological samples being interrogated at heterozygous or homozygous for the polymorphisms. According to aspects of the invention, subjects that contain one or more loci with an insertion or deletion can be identified by analyzing capture efficiencies for nucleic acids obtained from one or more biological samples using appropriate controls (e.g., capture efficiencies for known nucleic acid sizes, capture efficiencies for other regions that are not suspected of containing an insertion or deletion in the biological sample(s), or predetermined reference capture efficiencies, or any combination thereof. However, it should be appreciated that aspects of the invention are not limited by the nature or presence of the control. In some embodiments, if a statistically significant variation in capture efficiency is detected, a subject may be identified as being at risk for a disease or condition associated with insertions or deletions at that genetic locus. In some embodiments, the subject may be analyzed in greater detail in order to determine the precise nature of the insertion or deletion and whether the subject is heterozygous or homozygous for one or more insertions or deletions. For example, gel electrophoresis of an amplification (e.g., PCR) product of the locus, or Southern blotting, or any combination thereof can be used as an orthogonal approach to verify the length of the locus. In some embodiments, a more exhaustive and detailed sequence analysis of the locus can be performed to identify the number and types of insertions and deletions. However, other techniques may be used to further analyze a locus identified as having an abnormal length according to aspects of the invention.

Accordingly, aspects of the invention relate to detecting abnormal nucleic acid lengths in genomic regions of interest. In some embodiments, the invention aims to estimate the size of genomic regions that are hard to be accessed, such as repetitive elements. However, it should be appreciated that methods of the invention do not require that the precise length be estimated. In some embodiments, it is sufficient to determine that one or more alleles with abnormal lengths are present at a locus of interest (e.g., based on the detection of abnormal capture efficiencies).

In a non-limiting example, fragile X can be used to illustrate aspects of the invention where the size of trinucleotide repeats (genotype) is linked to a symptom (phenotype). However, it should be appreciated that fragile X is a non-limiting example and similar analyses may be performed for other genetic loci (e.g., independently or simultaneously in multiplex analyses).

Figure 8:
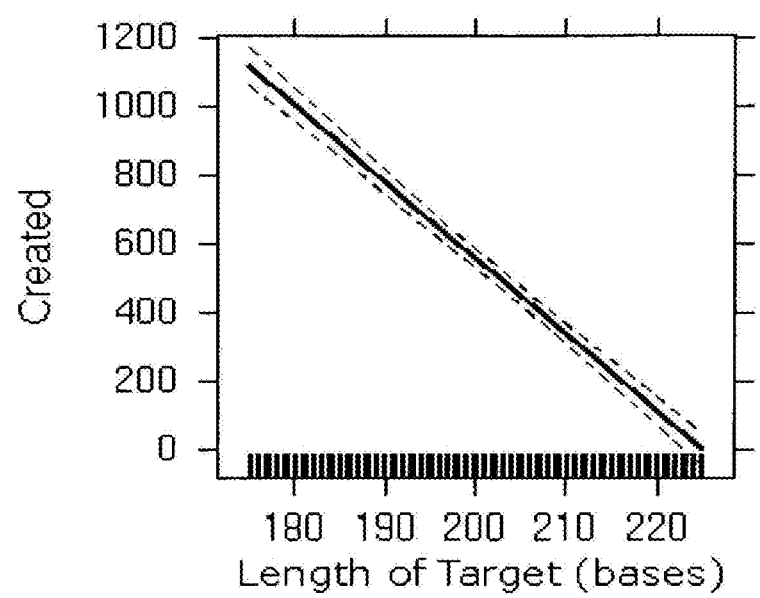
FIG. 8 illustrates that shorter sequences are captured with higher efficiency that longer sequences using MIPs.

Use of molecular inversion probes (MIPs) has been demonstrated for detection of single nucleotide polymorphisms (Hardenbol et al. 2005 Genome Res 15:269-75) and for preparative amplification of large sets of exons (Porreca et al. 2007 Nat Methods 4:931-6, Krishnakumar et al. 2008 Proc Natl Acad Sci USA 105:9296-301). In both cases, oligonucleotide probes are designed which have ends ('targeting arms') that hybridize up-stream and down-stream of the locus that is to be amplified. In some embodiments, aspects of the invention are based on the recognition that the effect of length on probe capturing efficiency can be used in the context of an assay (e.g., a high throughput and/or multiplex assay) to allow the length of sequences to be determined without requiring sequencing of the entire region being evaluated. This is particularly useful for repeat regions that are prone to changes in size. As illustrated in FIG. 8, which is reproduced from Deng et al., Nature Biotech. 27:353-60, (see Supplemental FIG. 1G of Deng et al.) illustrates that shorter sequences are captured with higher efficiency that longer sequences using MIPs. The statistical package Rand its effects module were used for this analysis. A linear model was used, and each individual factor was assumed to be independent. The dashed lines represent a 95% confidence interval. Shorter target sequences were captured with higher efficiency than long target sequences ($p<2\times10-16$). However, the use of this differential capture efficiency for systematic sequence length analysis was not previously recognized.

In some embodiments, following probe hybridization, polymerase fill-in and ligation reactions are performed to convert the hybridized probe to a covalently-closed, circular molecule containing the desired target. PCR or rolling circle amplification plus exonuclease digestion of non-circularized material is performed to isolate and amplify the circular targets from the starting nucleic acid pool. Since one of the main benefits of the method is the potential for a high degree of multiplexing, generally thousands of targets are captured in a single reaction containing thousands of probes.

According to aspects of the invention, repetitive regions are surrounded by non-repetitive unique sequences, which can be used to amplify the repeat-containing regions using, for example, PCR or padlock (MIP)-based method.

Figure 9:
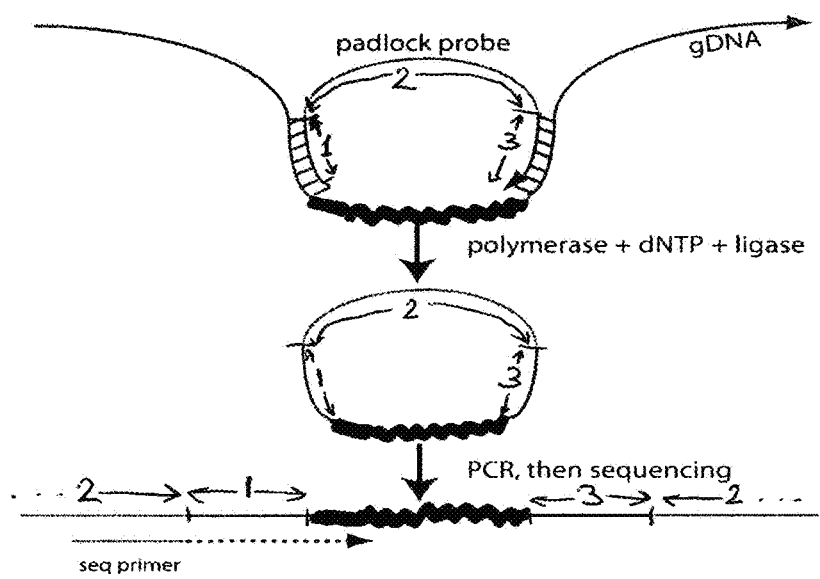
FIG. 9 illustrates a non-limiting scheme of padlock (MIP) capture of a region that includes both repetitive regions (thick wavy line) and the adjacent unique sequence (thick strait line)

In addition to the repetitive regions, a probe (e.g., a MIP or padlock probe) can be designed to include at least a sequence that is sufficient to be uniquely identified in the genome (or target pool). After the probe is circularized and amplified, the amplicon can be end-sequenced so that the unique sequence can be identified and served as the "representative" of the repetitive region as illustrated in FIG. 9. FIG. 9 illustrates a non-limiting scheme of padlock (MIP) capture of a region that includes both repetitive regions (thick wavy line) and the adjacent unique sequence (thick strait line). The regions of the probe are indicated with the targeting arms shown as regions "1" and "3." An intervening region that may be, or include, a sequencing primer binding site is shown as "2." After the padlock is circularized and amplified, it can be end-sequenced to obtain the sequence of the unique sequence, which represents the repetitive region of interest. Although capturing efficiency is overall negatively correlated with target length, different probe sequences may have unique features. Therefore, multiple probes could be designed and tested so that an optimal one is chosen to be sensitive enough to differentiate repetitive sizes of roughly 0-150 bp, 150-600 bp, and beyond, which represent normal, premutation and full mutation of fragile X syndrome, respectively. However, it should be appreciated that other probe sizes and sequences can be designed, and optionally optimized, to distinguish a range of repeat region size differences (e.g., length differences of about 3-30 bases, about 30-60 bases, about 60-90 bases, about 90-120 bases, about 120-150 bases, about 150-300 bases, about 300-600 bases, about 600-900 bases, or any intermediate or longer length difference). It should be appreciated that a length difference may be an increase in size or a decrease in size.

In some embodiments, an initial determination of an unexpected capture frequency is indicative of the presence of size difference. In some embodiments, an increase in capture frequency is indicative of a deletion. In some embodiments, a decrease in capture frequency is indicative of an insertion. However, it should be appreciated that depending on specific sequence parameters and the relative sizes of the capture probes, the target region, and the deletions or insertions, a change in capture frequency can be associated with either an increase or decrease in target region length. In some embodiments, the precise nature of the change can be determined using one or more additional techniques as described herein.

Accordingly, in some aspects a MIP probe includes a linear nucleic acid strand that contains two hybridization sequences or targeting arms, one at each end of the linear probe, wherein each of the hybridization sequences is complementary to a separate sequence on a the same strand of a target nucleic acid, and wherein these sequences on the target nucleic acid flank the two ends of the target nucleic acid sequence of interest. It should be appreciated that upon hybridization, the two ends of the probe are inverted with respect to each other in the sense that both 5' and 3' ends of the probe hybridize to the same strand to separate regions flanking the target region (as illustrated in FIG. 9 for example).

In some embodiments, the hybridization sequences are between about 10-100 nucleotides long, for example between about 10-30, about 30-60, about 60-90, or about 20, about 30, about 40, or about 50 nucleotides long. However, other lengths may be used depending on the application. In some embodiments, the hybridization Tins of both targeting arms of a probe are designed or selected to be similar. In some embodiments, the hybridization Tms of the targeting arms of a plurality of probes designed to capture different target regions are selected or designed to be similar so that they can be used together in a multiplex reaction. Accordingly, a typical size of a MIP probe prior to fill-in is about 60-80 nucleotides long. However, other sizes can be used depending on the sizes of the targeting arms and any other sequences (e.g., primer binding or tag sequences) that are present in the MIP probe. In some embodiments, MIP probes are designed to avoid sequence-dependent secondary structures. In some embodiments, MIP probes are designed such that the targeting arms do not overlap with known polymorphic regions. In some embodiments, targeting arms that can be used for capturing the repeat region of the Fragile X locus can have the following sequences or complementary to these sequences depending on the strand that is captured.

```
left:   CTCCGTTTCGGTTTCACTTC  (SEQ ID NO: 181)
right:  ATCTTCTCTTCAGCCCTGCT  (SEQ ID NO: 182)
```

The typical captured size using these targeting arms is about 100 nucleotides in length (e.g., about 30 repeats of a tri-nucleotide repeat).

Figure 10:
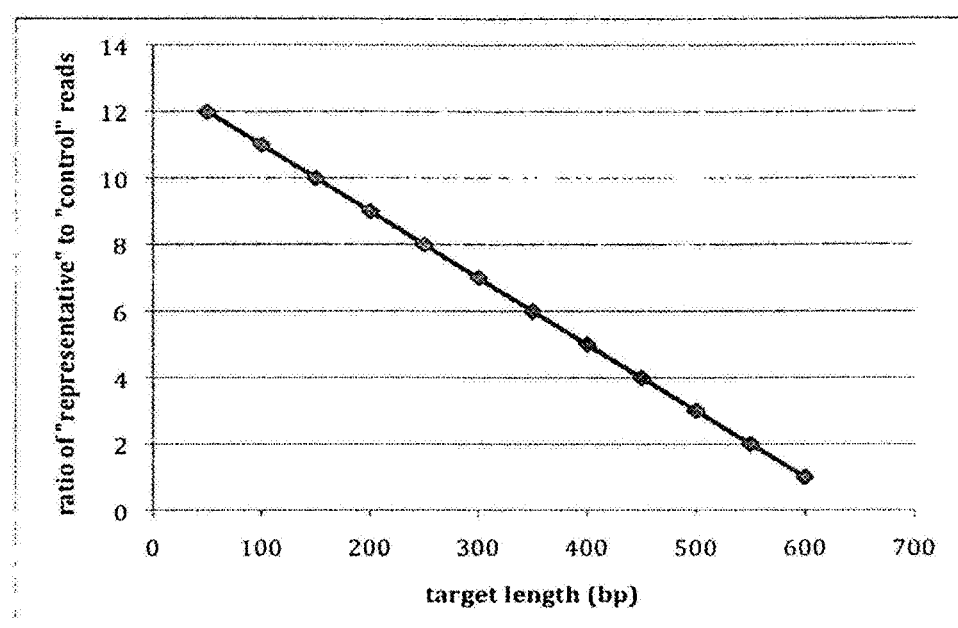
FIG. 10 illustrates a non-limiting hypothetical relationship between target gap size and the relative number of reads of the repetitive region.

In some embodiments, the number of reads obtained for the "representative" of the repetitive region is not informative to estimate the target length because it is dependent on the total number of reads obtained. To overcome this, it is useful to include one or more probes that target other "control" regions where no or minimal polymorphism exists among populations. Because of the systematic consistency of capturing efficiency (see, e.g., FIG. 9), the ratio of reads obtained for the repetitive "representative" to reads obtained for the control region(s) will be tuned using DNA with defined numbers of repeats. Ultimately, the ratio can serve as a measure of the repeat length as illustrated in FIG. 10. FIG. 10 illustrates a non-limiting hypothetical relationship between target gap size and the relative number of reads of the repetitive region, which is measured by the ratio of the repeat "representative" reads vs. the "control" region reads. The unit of y-axis is arbitrary.

In some embodiments, to better tell targets with similar size range apart, the whole repetitive region can be sequenced by making a shotgun library (e.g., by making a shotgun library from a captured sequence, for example a sequence captured using a MIP probe). The longer the repeat is, the more short reads of repeats will be obtained. Therefore, the target length will contribute twice to the relative number of "repetitive" reads, which will gain better resolution of differentiating targets. In some embodiments, the expectation is that the number of reads from any given repeat will be a direct function of the number of repeats present. However, in some embodiments, a Poisson sampling-induced spread may need to be considered and in some embodiments may be sufficiently large to limit the resolution.

Figure 11A:
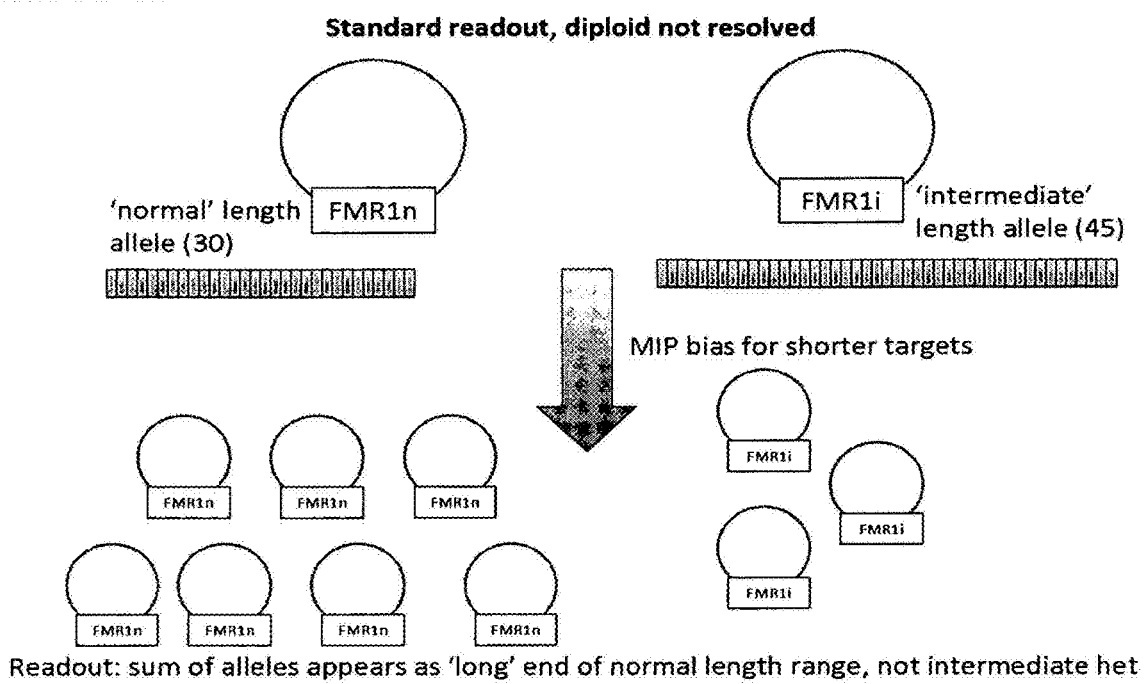
FIG. 11A depicts MIP capture of FMR1 repeat regions from a diploid genome.
Figure 11B:
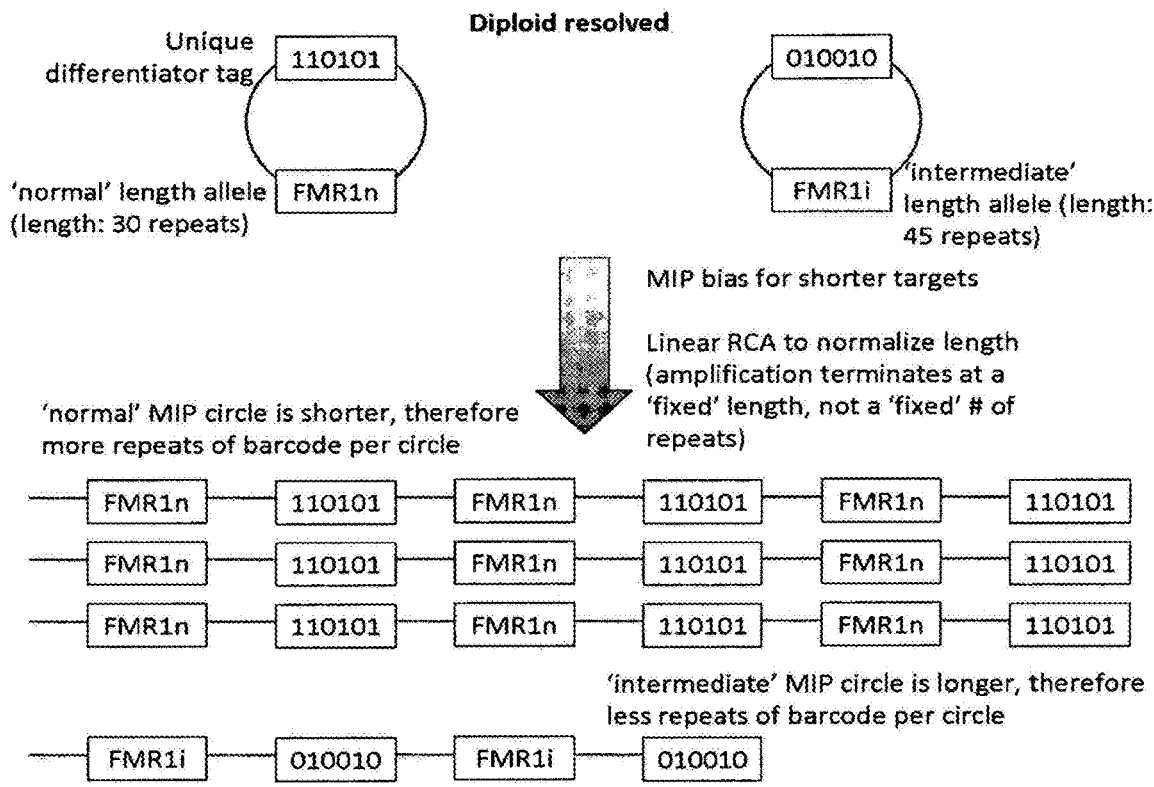
FIG. 11B depicts preparative methods for biallelic resolution of FMR1 repeat region lengths in a diploid genome using MIP capture probes and unique differentiator tags.
Figure 11C:
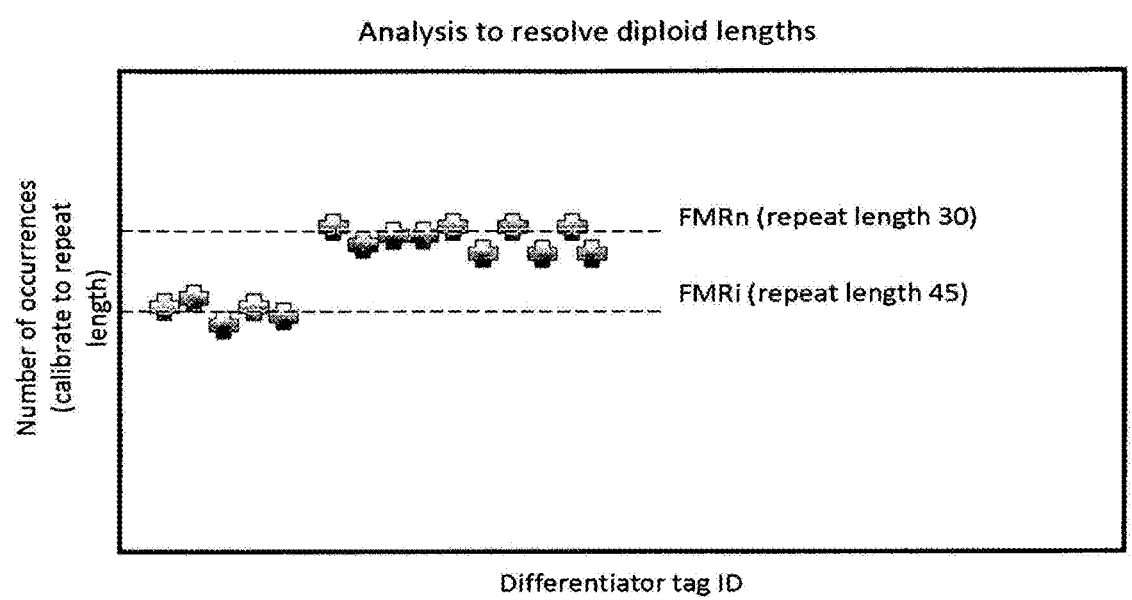
FIG. 11C depicts an analysis of FMR1 repeat region lengths in a diploid genome.

When a precise measurement of the length of both alleles from a diploid sample is desired, further manipulations may be required. This is because the capture efficiency measured will actually be the average efficiency of the two alleles. To effectively achieve separate measurements for each allele, barcodes (e.g., sequence tags) can be used that allow the efficiency of individual capture events (from individual genomic loci) to be followed. FIG. 11A-C shows the approach. For a given locus, MIPs are synthesized to contain one of a large number of differentiator tags in their backbone such that the probability of any two MIPs in a reaction having the same differentiator tag sequence is low. MIP capture is performed on the sample; the reaction will be biased for shorter target lengths, and therefore the reaction product will be comprised of more 'short' circles than 'long' circles. Each circle should bear a unique differentiator tag sequence. Then, linear RCA (IRCA) is performed on the circles. In the IRCA reaction, circles are converted into long, linear concatemers of themselves. The IRCA reaction for a given circle stops when the concatemer has reached a 'fixed' length (based on the processivity/error rate of the polymerase). Concatemers derived from smaller circles will therefore contain more copies of the differentiator tag, and concatemers derived from larger circles will contain fewer copies of the differentiator tag. The number of each differentiator tag sequence is counted, for example, by next-generation sequencing. When number of occurrences is plotted against differentiator tag ID, the data will naturally cluster into two groups reflecting the lengths of the two alleles in the diploid sample. The allele lengths can therefore be read directly off this graph, after absolute length calibration using known standards. In some embodiments, a sequencing technique (e.g., a next-generation sequencing technique) is used to sequence part of one or more captured targets (e.g., or amplicons thereof) and the sequences are used to count the number of different barcodes that are present. Accordingly, in some embodiments, aspects of the invention relate to a highly-multiplexed qPCR reaction.

Other non-limiting examples of loci at which insertions or deletions or repeat sequences may be associated with a disease or condition are provided in Tables 3 and 4. It should be appreciated that the presence of an abnormal length at any one or more of these loci may be evaluated according to aspects of the invention. In some embodiments, two or more of these loci or other loci may be evaluated in a single multiplex reaction using different probes designed to hybridize under the same reaction conditions to different target nucleic acid in a biological sample.

TABLE 3

Polyglutamine (PolyQ) Diseases

| Type | Gene | Normal/wildtype | Pathogenic |
|---|---|---|---|
| DRPLA (Dentatorubropallidoluysian atrophy) | ATN1 or DRPLA | 6-35 | 49-88 |
| HD (Huntington's disease) | HTT (Huntingtin) | 10-35 | 35+ |
| SBMA (Spinobulbar muscular atrophy or Kennedy disease) | Androgen receptor on the X chromosome. | 9-36 | 38-62 |
| SCA1 (Spinocerebellar ataxia Type 1) | ATXN1 | 6-35 | 49-88 |
| SCA2 (Spinocerebellar ataxia Type 2) | ATXN2 | 14-32 | 33-77 |
| SCA3 (Spinocerebellar ataxia Type 3 or Machado-Joseph disease) | ATXN3 | 12-40 | 55-86 |
| SCA6 (Spinocerebellar ataxia Type 6) | CACNA1A | 4-18 | 21-30 |
| SCA7 (Spinocerebellar ataxia Type 7) | ATXN7 | 7-17 | 38-120 |
| SCA17 (Spinocerebellar ataxia Type 17) | TBP | 25-42 | 47-63 |

TABLE 4

Non-Polyglutamine Diseases

| Type | Gene | Codon | Normal/wildtype | Pathogenic |
|---|---|---|---|---|
| FRAXA (Fragile X syndrome) | FMR1, on the X-chromosome | CGG | 6-53 | 230+ |

TABLE 4-continued

Non-Polyglutamine Diseases

| Type | Gene | Codon | Normal/wildtype | Pathogenic |
|---|---|---|---|---|
| FXTAS (Fragile X-associated tremor/ataxia syndrome) | FMR1, on the X-chromosome | CGG | 6-53 | 55-200 |
| FRAXE (Fragile XE mental retardation) | AFF2 or FMR2, on the X-chromosome | GCC | 6-35 | 200+ |
| FRDA (Friedreich's ataxia) | FXN or X25, (frataxin) | GAA | 7-34 | 100+ |
| DM (Myotonic dystrophy) | DMPK | CTG | 5-37 | 50+ |
| SCA8 (Spinocerebellar ataxia Type 8) | OSCA or SCA8 | CTG | 16-37 | 110-250 |
| SCA12 (Spinocerebellar ataxia Type 12) | PPP2R2B or SCA12 | CAG On 5' end | 7-28 | 66-78 |

The following examples illustrate aspects and embodiments of the invention and are not intended to be limiting or restrictive. Many variations of the invention will become apparent to those skilled in the art upon review of this specification. The full scope of the invention should be determined by reference to the claims, along with their full scope of equivalents, and the specification, along with such variations.

4. Increasing Detection Sensitivity:

In some embodiments, aspects of the invention relate to methods for increasing the sensitivity of nucleic acid detection assays.

There are currently many genomic assays that utilize next-generation (e.g., polony-based) sequencing to generate data, including genome resequencing, RNA-seq for gene expression, bisulphite sequencing for methylation, and Immune-seq, among others. In order to make quantitative measurements (including genotype calling), these methods utilize the counts of sequencing reads of a given genomic locus as a proxy for the representation of that sequence in the original sample of nucleic acids. The majority of these techniques require a preparative step to construct a high-complexity library of DNA molecules that is representative of a sample of interest. Current assays use one of several alternative nucleic acid preparative techniques (e.g., amplification, for example PCR-based amplification; sequence-specific capture, for example, using immobilized capture probes; or target capture into a circularized probe followed by a sequence analysis step. In order to reduce errors associated with the unpredictability (stochastic nature) of nucleic acid isolation and sequence analysis techniques, current methods to involve oversampling a target nucleic acid preparation in order to increase the likelihood that all sequences that are present in the original nucleic acid sample will be represented in the final sequence data. For example, a genomic sequencing library may contain an over- or under-representation of particular sequences from a source nucleic acid sample (e.g., genome preparation) as a result of stochastic variations in the library construction process. Such variations can be particularly problematic when they result in target sequences from a genome being absent or undetectable in a sequencing library. For example, an under-representation of particular allelic sequences (e.g., heterozygotic alleles) from a genome in a sequencing library can result in an apparent homozygous representation in a sequencing library.

In contrast, aspects of the invention relate to basing a nucleic acid sequence analysis on results from two or more different nucleic acid preparatory techniques that have different systematic biases in the types of nucleic acids that they sample rather than simply oversampling the target nucleic acid. According to some embodiments, different techniques have different sequence biases that are systematic and not simply due to stochastic effects during nucleic acid capture or amplification. Accordingly, in some embodiments, the degree of oversampling required to overcome variations in nucleic acid preparation needs to be sufficient to overcome the biases. In some embodiments, the invention provides methods that reduce the need for oversampling by combining nucleic acid and/or sequence results obtained from two or more different nucleic acid preparative techniques that have different biases.

According to the invention, different techniques have different characteristic or systematic biases. For example, one technique may bias a sample analysis towards one particular allele at a genetic locus of interest, whereas a different technique would bias the sample analysis towards a different allele at the same locus. Accordingly, the same sample may be identified as being different depending on the type of technique that is used to prepare nucleic acid for sequence analysis. This effectively represents a sensitivity issue, because each technique has a different relative sensitivities for polymorphic sequences of interest.

According to aspects of the invention, the sensitivity of a nucleic acid analysis can be increased by combining the sequences from different nucleic acid preparative steps and using the combined sequence information for a diagnostic assay (e.g., for a making a call as to whether a subject is homozygous or heterozygous at a genetic locus of interest).

Currently, the ability of DNA sequencing to detect mutations is limited by the ability of the upstream sample isolation (e.g., by amplification, immobilization enrichment, circularization capture, etc.) methods to reliably isolate the locus of interest. If one wishes to make heterozygote basecalls for a diploid genome (e.g. a human sample presented for molecular diagnostic sequencing), it is important in some embodiments that the isolation method produces near- or perfectly-uniform amounts of the two alleles to be sequenced (at least sufficiently uniform to be "called" unambiguously as a heterozygote or a homozygote for a locus of interest).

Sample preparative methods may fall into three classes: 1) single- or several-target amplification (e.g., uniplex PCR, 'multiplex' PCR), 2) multi-target hybridization enrichment (e.g., Agilent SureSelect 'hybrid capture' [Gnirke et al 2009, Nature methods 27:182-9], Roche/Nimblegen 'sequence capture' [Hodges et al 2007, Nature genetics 39:1522-7], and 3) multi-target circularization selection (e.g. molecular inversion probes or padlock probes, [Porreca et al 2007, Nature methods 4:931-6, Turner et al 2009, Nature methods 6:315-6], 'selectors' [Dahl et al 2005, Nucleic acids research 33:e71]). Each of these methods can result in a pool of isolated product that does not adequately represent the input abundance distribution. For example, the two alleles at a heterozygous position can become skewed far from their input 50:50 ratio to something that results in a missed basecall during downstream sequencing. For example, if the ratio was skewed from 50:50 to 10:90, and the sample was sequenced to 10× average coverage, there is a high probability that one of the two alleles would not be observed once in the ten sequencing reads. This would reduce the sensitivity of the sequencing method by converting a heterozygous position to homozygous (where potentially the 'mutant' allele was the one not observed). In some embodiments, a skewed ratio is a particular issue that decreases the sensitivity of detecting mutations present in a heterogeneous tumor tissue. For example, if only 10% of the cells analyzed in a heterogeneous sample harbored a heterozygous mutation, the mutation would be expected to be present in 5% of sequence reads, not 50%. In this scenario, the need for robust, sensitive detection may be even more acute.

The methods disclosed herein are based, in part, on the discovery that certain classes of isolation methods have different modes of bias. The disclosure provide methods for increasing the sensitivity of the downstream sequencing by using a combination of multiple isolation methods (e.g., one or more from at least two of the classes disclosed herein) for a sample. This is particularly important in molecular diagnostics where high sensitivity is required to minimize the chances of 'missing' a disease-associated mutation. For example, given a nominal false-negative error rate of $1 \times 10-3$ for sequencing following circularization selection, and a false-negative error rate of $1 \times 10-3$ for sequencing following hybridization enrichment, one can achieve a final false-negative rate of $1 \times 10-6$ by performing both techniques on the sample (assuming failures in each method are fully independent). For a recessive disease with carrier frequency of 0.1, caused by a single fully-penetrant mutant allele, the number of missed carrier diagnoses would decrease from 1000 per million patients tested to 1 per million patients tested. Furthermore, if the testing was used in the context of prenatal carrier screening, the number of affected children born as a result of missing the carrier call in one parent would decrease from 25 per million to 25 per billion born.

Additionally, the disclosure provides combinations of preparative methods to effectively increase sequencing coverage in regions containing disease-associated alleles. Since heterozygote error rate is largely tied to both deviations from 50:50 allele representation, and in the case of next-generation DNA sequencing deviations from average abundance (such that less abundant isolated targets are more likely to be undersampled at one or both alleles), selectively increasing coverage in these regions will also selectively increase sensitivity. Furthermore, MIPs that detect presence or absence of specific known disease-associated mutations can be used to increase sensitivity selectively. In some embodiments, these MIPs would have a targeting arm whose 3'-most region is complementary to the expected mutation, and has a fill-in length of O or more bp. Thus, the MIP will form only if the mutation is present, and its presence will be detected by sequencing.

Figure 12:
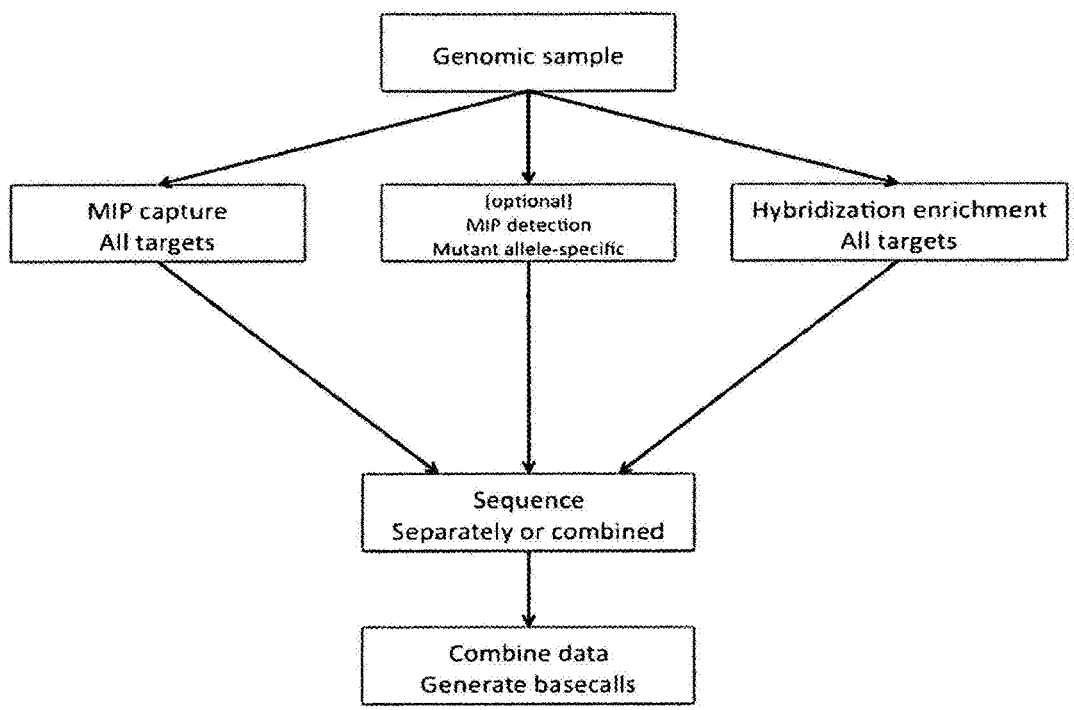
FIG. 12 is a schematic of an embodiment of an algorithm of the invention.

Additionally, algorithms disclosed herein may be used to determine base identity with varying levels of stringency depending on whether the given position has any known disease-associated alleles. Stringency can be reduced in such positions by decreasing the minimum number of observed mutant reads necessary to make a consensus base-call. This will effectively increase sensitivity for mutant allele detection at the cost of decreased specificity. An embodiment of the invention combines MIPs plus hybridization enrichment, plus optionally extra MIPs targeted to specific known, common disease-associated loci, e.g., to detect the presence of a polymorphism in a target nucleic acid. A non-limiting example is illustrated in FIG. 12 that illustrates a schematic using MIPs plus hybridization enrichment, plus optionally extra MIPs targeted to specific known, common disease-associated loci, e.g., to detect the presence of a polymorphism in a target nucleic acid.

Figure 13:
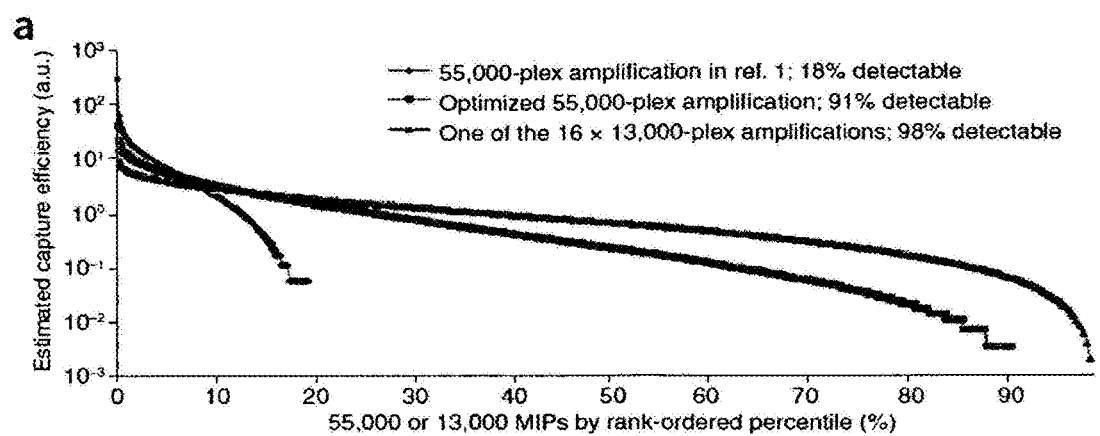
FIG. 13 illustrates a non-limiting example of a graph of per-target abundance with MIP capture; and, FIG. 14 shows a non-limiting a graph of correlation between two MIP capture reactions.
Figure 14:
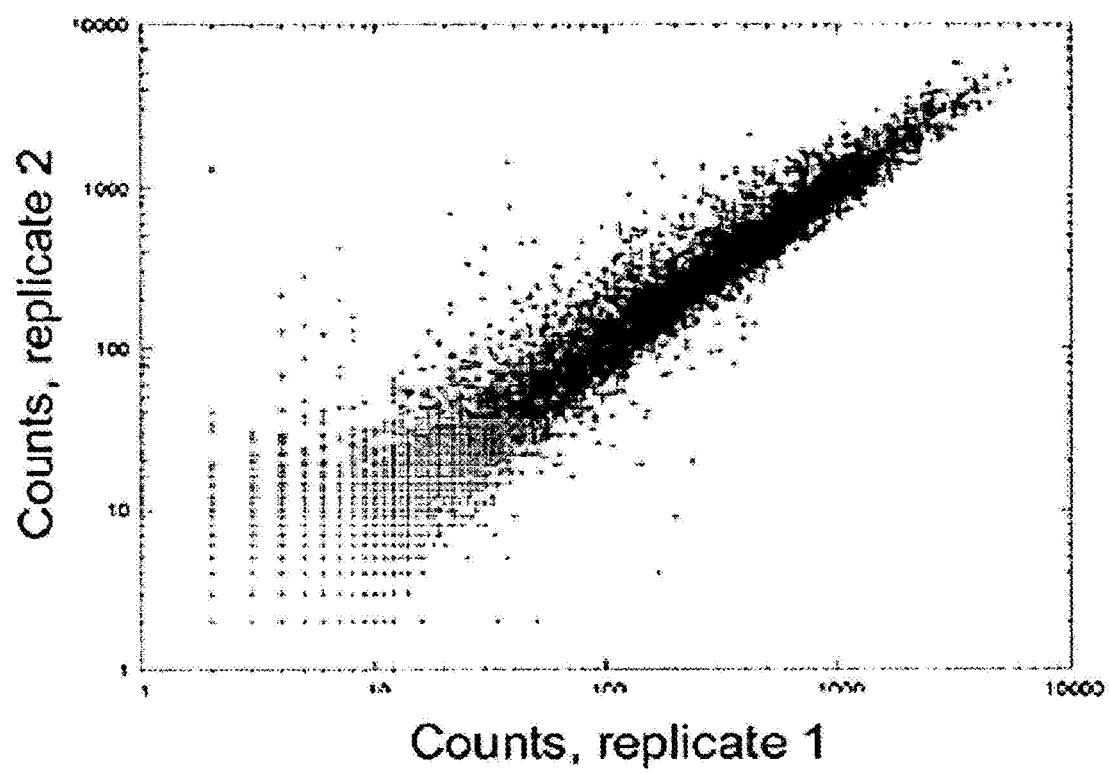

FIGS. 13 and 14 illustrate different capture efficiencies for MIP-based captures. FIG. 13 shows a graph of per-target abundance with MIP capture. In this graph, bias largely drives the heterozygote error rate, since targets which are less abundant here are less likely to be covered in sufficient depth during sequencing to adequately sample both alleles. This is from Turner et al 2009, Nature methods 6:315-6. Hybridization enrichment results in a qualitatively similar abundance distribution, but the abundance of a given target is likely not correlated between the two methods. FIG. 14 shows a graph of correlation between two MIP capture reactions from Ball et al 2009, Nature biotechnology 27:361-8. Each point represents the target abundance in replicate 1 and replicate 2. Pearson correlation r=0.956. This indicates that MIP capture reproducibly biases targets to specific abundances. Hybridization enrichment is similarly correlated from one capture to the next.

According to aspects of the invention, such biases can be detected or overcome by systematically combining different capture and/or analytical techniques in an assay that interrogates a plurality of loci in a plurality of subject samples.

Accordingly, it should be appreciated that in any of the embodiments described herein (e.g., tiling/staggering, tagging, size-detection, sensitivity enhancing algorithms, or any combination thereof), aspects of the invention involve preparing genomic nucleic acid and/or contacting them with one or more different probes (e.g., capture probes, hybridization probes, MIPs, others etc.). In some embodiments, the amount of genomic nucleic acid used per subject ranges from 1 ng to 10 micrograms (e.g., 500 ng to 5 micrograms). However, higher or lower amounts (e.g., less than 1 ng, more than 10 micrograms, 10-50 micrograms, 50-100 micrograms or more) may be used. In some embodiments, for each locus of interest, the amount of probe used per assay may be optimized for a particular application. In some embodiments, the ratio (molar ratio, for example measured as a concentration ratio) of probe to genome equivalent (e.g., haploid or diploid genome equivalent, for example for each allele or for both alleles of a nucleic acid target or locus of interest) ranges from 1/100, 1/10, 1/1, 10/1, 100/1, 1000/1. However, lower, higher, or intermediate ratios may be used.

In some embodiments, the amount of target nucleic acid and probe used for each reaction is normalized to avoid any observed differences being caused by differences in concentrations or ratios. In some embodiments, in order to normalize genomic DNA and probe, the genomic DNA concentration is read using a standard spectrophotometer or by fluorescence (e.g., using a fluorescent intercalating dye). The probe concentration may be determined experimentally or using information specified by the probe manufacturer.

Similarly, once a locus has been captured (e.g., on a MIP or other probe or in another form), it may be amplified and/or sequenced in a reaction involving one or more primers. The amount of primer added for each reaction can range from 0.1 pmol to 1 nmol, 0.15 pmol to 1.5 nmol (for example around 1.5 pmol). However, other amounts (e.g., lower, higher, or intermediate amounts) may be used.

In some embodiments, it should be appreciated that one or more intervening sequences (e.g., sequence between the first and second targeting arms on a MIP capture probe), identifier or tag sequences, or other probe sequences that are not designed to hybridize to a target sequence (e.g., a genomic target sequence) should be designed to avoid excessive complementarity (to avoid cross-hybridization) to target sequences or other sequences (e.g., other genomic sequences) that may be in a biological sample. For example, these sequences may be designed have a sufficient number of mismatches with any genomic sequence (e.g., at least 5, 10, 15, or more mismatches out of 30 bases) or as having a Tm (e.g., a mismatch Tm) that is lower (e.g., at least 5, 10, 15, 20, or more degrees C. lower) than the hybridization reaction temperature.

It should be appreciated that a targeting arm as used herein may be designed to hybridize (e.g., be complementary) to either strand of a genetic locus of interest if the nucleic acid being analyzed is DNA (e.g., genomic DNA). However, in the context of MIP probes, whichever strand is selected for one targeting arm will be used for the other one. However, in the context of RNA analysis, it should be appreciated that a targeting arm should be designed to hybridize to the transcribed RNA. It also should be appreciated that MIP probes referred to herein as "capturing" a target sequence are actually capturing it by template-based synthesis rather than by capturing the actual target molecule (other than for example in the initial stage when the arms hybridize to it or in the sense that the target molecule can remain bound to the extended MIP product until it is denatured or otherwise removed).

It should be appreciated that in some embodiments a targeting arm may include a sequence that is complementary to one allele or mutation (e.g., a SNP or other polymorphism, a mutation, etc.) so that the probe will preferentially hybridize (and capture) target nucleic acids having that allele or mutation. However, in many embodiments, each targeting arm is designed to hybridize (e.g., be complementary) to a sequence that is not polymorphic in the subjects of a population that is being evaluated. This allows target sequences to be captured and/or sequenced for all alleles and then the differences between subjects (e.g., calls of heterozygous or homozygous for one or more loci) can be based on the sequence information and/or the frequency as described herein.

It should be appreciated that sequence tags (also referred to as barcodes) may be designed to be unique in that they do not appear at other positions within a probe or a family of probes and they also do not appear within the sequences being targeted. Thus they can be used to uniquely identify (e.g., by sequencing or hybridization properties) particular probes having other characteristics (e.g., for particular subjects and/or for particular loci).

It also should be appreciated that in some embodiments probes or regions of probes or other nucleic acids are described herein as comprising or including certain sequences or sequence characteristics (e.g., length, other properties, etc.). However, it should be appreciated that in some embodiments, any of the probes or regions of probes or other nucleic acids consist of those regions (e.g., arms, central regions, tags, primer sites, etc., or any combination thereof) of consist of those sequences or have sequences with characteristics that consist of one or more characteristics (e.g., length, or other properties, etc.) as described herein in the context of any of the embodiments (e.g., for tiled or staggered probes, tagged probes, length detection, sensitivity enhancing algorithms or any combination thereof).

It should be appreciated that probes, primers, and other nucleic acids designed or used herein may be synthetic, natural, or a combination thereof. Accordingly, as used herein, the term "nucleic acid" refers to multiple linked nucleotides (i.e., molecules comprising a sugar (e.g., ribose or deoxyribose) linked to an exchangeable organic base, which is either a pyrimidine (e.g., cytosine (C), thymidine (T) or uracil (U)) or a purine (e.g., adenine (A) or guanine (G)). "Nucleic acid" and "nucleic acid molecule" may be used interchangeably and refer to oligoribonucleotides as well as oligodeoxyribonucleotides. The terms shall also include polynucleosides (i.e., a polynucleotide minus a phosphate) and any other organic base containing nucleic acid. The organic bases include adenine, uracil, guanine, thymine, cytosine and inosine. Unless otherwise stated, nucleic acids may be single or double stranded. The nucleic acid may be naturally or non-naturally occurring. Nucleic acids can be obtained from natural sources, or can be synthesized using a nucleic acid synthesizer (i.e., synthetic). Harvest and isolation of nucleic acids are routinely performed in the art and suitable methods can be found in standard molecular biology textbooks. (See, for example, Maniatis' Handbook of Molecular Biology.) The nucleic acid may be DNA or RNA, such as genomic DNA, mitochondrial DNA, mRNA, cDNA, rRNA, miRNA, or a combination thereof. Non-naturally occurring nucleic acids such as bacterial artificial chromosomes (BACs) and yeast artificial chromosomes (YACs) can also be used.

The invention also contemplates the use of nucleic acid derivatives. As will be described herein, the use of certain nucleic acid derivatives may increase the stability of the nucleic acids of the invention by preventing their digestion, particularly when they are exposed to biological samples that may contain nucleases. As used herein, a nucleic acid derivative is a non-naturally occurring nucleic acid or a unit thereof. Nucleic acid derivatives may contain non-naturally occurring elements such as non-naturally occurring nucleotides and non-naturally occurring backbone linkages.

Nucleic acid derivatives may contain backbone modifications such as but not limited to phosphorothioate linkages, phosphodiester modified nucleic acids, phosphorothiolate modifications, combinations of phosphodiester and phosphorothioate nucleic acid, methylphosphonate, alkylphosphonates, phosphate esters, alkylphosphonothioates, phosphoramidates, carbamates, carbonates, phosphate triesters, acetamidates, carboxymethyl esters, methylphosphorothioate, phosphorodithioate, p-ethoxy, and combinations thereof. The backbone composition of the nucleic acids may be homogeneous or heterogeneous.

Nucleic acid derivatives may contain substitutions or modifications in the sugars and/or bases. For example, they include nucleic acids having backbone sugars which are covalently attached to low molecular weight organic groups other than a hydroxyl group at the 3' position and other than a phosphate group at the 5' position (e.g., an 2'-O-alkylated ribose group). Nucleic acid derivatives may include non-ribose sugars such as arabinose. Nucleic acid derivatives may contain substituted purines and pyrimidines such as C–5 propyne modified bases, 5-methylcytosine, 2-aminopurine, 2-amino-6-chloropurine, 2,6-diaminopurine, hypoxanthine, 2-thiouracil and pseudoisocytosine. In some embodiments, substitution(s) may include one or more substitutions/modifications in the sugars/bases, groups attached to the base, including biotin, fluorescent groups (fluorescein, cyanine, rhodamine, etc), chemically-reactive groups including carboxyl, NHS, thiol, etc., or any combination thereof.

A nucleic acid may be a peptide nucleic acid (PNA), locked nucleic acid (LNA), DNA, RNA, or co-nucleic acids of the same such as DNA-LNA co-nucleic acids. PNA are DNA analogs having their phosphate backbone replaced with 2-aminoethyl glycine residues linked to nucleotide bases through glycine amino nitrogen and methylenecarbonyl linkers. PNA can bind to both DNA and RNA targets by Watson-Crick base pairing, and in so doing form stronger hybrids than would be possible with DNA or RNA based oligonucleotides in some cases.

PNA are synthesized from monomers connected by a peptide bond (Nielsen, P. E. et al. Peptide Nucleic Acids, Protocols and Applications, Norfolk: Horizon Scientific Press, p. 1-19 (1999)). They can be built with standard solid phase peptide synthesis technology. PNA chemistry and synthesis allows for inclusion of amino acids and polypeptide sequences in the PNA design. For example, lysine residues can be used to introduce positive charges in the PNA backbone. All chemical approaches available for the modifications of amino acid side chains are directly applicable to PNA. Several types of PNA designs exist, and these include single strand PNA (ssPNA), bisPNA and pseudo-complementary PNA (pcPNA).

The structure of PNA/DNA complex depends on the particular PNA and its sequence. ssPNA binds to single stranded DNA (ssDNA) preferably in antiparallel orientation (i.e., with the N-terminus of the ssPNA aligned with the 3' terminus of the ssDNA) and with a Watson-Crick pairing. PNA also can bind to DNA with a Hoogsteen base pairing, and thereby forms triplexes with double stranded DNA (dsDNA) (Wittung, P. et al., Biochemistry 36:7973 (1997)).

A locked nucleic acid (LNA) is a modified RNA nucleotide. An LNA form hybrids with DNA, which are at least as stable as PNA/DNA hybrids (Braasch, D. A. et al., Chem & Biol. 8(1):1-7 (2001)). Therefore, LNA can be used just as PNA molecules would be. LNA binding efficiency can be increased in some embodiments by adding positive charges to it. LNAs have been reported to have increased binding affinity inherently.

Commercial nucleic acid synthesizers and standard phosphoramidite chemistry are used to make LNAs. Therefore, production of mixed LNA/DNA sequences is as simple as that of mixed PNA/peptide sequences. The stabilization effect of LNA monomers is not an additive effect. The monomer influences conformation of sugar rings of neighboring deoxynucleotides shifting them to more stable configurations (Nielsen, P. E. et al. Peptide Nucleic Acids, Protocols and Applications, Norfolk: Horizon Scientific Press, p. 1-19 (1999)). Also, lesser number of LNA residues in the sequence dramatically improves accuracy of the synthesis. Most of biochemical approaches for nucleic acid conjugations are applicable to LNA/DNA constructs. These and other aspects of the invention are illustrated by the following non-limiting examples.

EXAMPLES

The following examples illustrate non-limiting embodiments of the invention.

Example 1

Design a Set of Capture Probes for a Human Target Exon
All targets are captured as a set of partially-overlapping subtargets. For example, in the tiling approach, a 200 bp target exon might be captured as a set of 12 subtargets, each 60 bp in length (FIG. 1). Each subtarget is chosen such that it partially overlaps two or three other targets.

In some embodiments, all probes are composed of three regions: 1) a 20 bp 'targeting arm' comprised of sequence which hybridizes immediately upstream from the sub-target, 2) a 30 bp 'constant region' comprised of sequence used as a pair of amplification priming sites, and 3) a second 20 bp 'targeting arm' comprised of sequence which hybridizes immediately downstream from the sub-target. Targeting arm sequences will be different for each capture probe in a set, while constant region sequence will be the same for all probes in the set, allowing all captured targets to be amplified with a single set of primers. Targeting arm sequences should be designed such that any given pair of 20 bp sequences is unique in the target genome (to prevent spurious capture of undesired sites). Additionally, melting temperatures should be matched for all probes in the set such that hybridization efficiency is uniform for all probes at a constant temperature (e.g., 60° C.). Targeting arm sequences should be computationally screened to ensure they do not form strong secondary structure that would impair their ability to basepair with the genomic target.

Hybridize Capture Probes to Human Genomic Sample
Assemble hybridization reaction:
ul capture probe mix (~2.5 pmol)
ul 10× Ampligase buffer (Epicentre)
6.0 ul 500 ng/ul human genomic DNA (~16.7 fmol) 11 ul dH2O In a thermal cycler, heat reaction to 95° C. for 5 min to denature genomic DNA, then cool to 60° C. Allow to incubate at 60° C. for 40 hours.

Convert Hybridized Probes into Covalently-Closed Circular Products Containing Subtargets Prepare fill-in/ligation reaction mixture:
0.25 ul 2 mM dNTP mix (Invitrogen)
2.5 ul 10× Ampligase buffer (Epicentre)
5.0 ul 5 U/ul Taq Stoffel fragment (Applied Biosystems)
12.5 ul 5 U/ul Ampligase (Epicentre)
4.75 ul dH2O
Add 1.0 ul of this mix to the hybridized probe reaction, and incubate at 60° C. for 10 hours.

Purify Circularized Probe/Subtarget Products from Un-Reacted Probes and Genomic DNA
Prepare exonuclease reaction mixture:
21 ul fill-in/ligation reaction product
ul 10× exonuclease I buffer (New England Biolabs)
2.0 ul 20 U/ul exonuclease I (New England Biolabs)
2.0 ul 100 U/ul exonuclease III (New England Biolabs)
Incubate at 37° C. for 60 min, then heat-inactivate by incubating at 80° C. for 15 min.
Immediately cool to 4 C for storage.

Amplify Circular Material by PCR Using Primers Specific to the 'Constant Region' of the Probes
Prepare PCR mixture:
5.0 u 10× Accuprime reaction buffer (Invitrogen) (SEQ ID NO: 183)
1.5 ul 10 uM CP-2-FA (5'-GCAC-GATCCGACGGTAGTGT-3') (SEQ ID NO: 184)
1.5 ul 10 uM CP-2-RA (5'-CCGTAATCGGGAAGCT-GAAG-3')
0.4 ul 25 mM dNTP mix (Invitrogen)
2.0 ul heat-inactivated exonuclease reaction mix
1.5 ul 10× SybrGreen (Invitrogen)
0.4 ul 2.5 U/ul Accuprime Pfx polymerase (Invitrogen)
37.7 ul dH2O Thermal cycle in real-time thermal cycler according to the following protocol, but stop cycling before amplification yield plateaus (generally 8-12 cycles):
95C for 5 min 95C for 30 sec 58C for 60 sec
72C for 60 sec
go to 2, N more times Prepare a Shotgun Next-Generation Sequencing Library for Analysis Purify desired amplicon population from non-specific amplification products by gel extraction.

Concatemerized amplicons into high-molecular weight products suitable for shearing Mechanically shear, using either a nebulizer, BioRuptor, Hydroshear, Covaris, or similar instrument. DNA should be sheared into fragments several hundred basepairs in length.

Ligate adapters required for amplification by the sequencing platform used. If necessary, purify ligated product from unligated product and adapters.

Example 2

Use of Differentiator Tag Sequences to Detect and Correct Bias in a MIP-Capture Reaction of a Set of Exon Targets The first step in performing the detection/correction is to determine how many differentiator tag sequences are necessary for the given sample. In this example, 1000 genomic targets corresponding to 1000 exons were captured. Since the differentiator tag sequence is part of the probe, it will measure/report biases that occur from the earliest protocol steps. Also, being located in the backbone, the differentiator tag sequence can easily be sequenced from a separate priming site, and therefore not impact the total achievable read-length for the target sequence. MIP probes are synthesized using standard column-based oligonucleotide synthesis by any number of vendors (e.g. IDT), and differentiator tag sequences are introduced as 'degenerate' positions in the backbone. Each degenerate position increases the total number of differentiator tag sequences synthesized by a factor of 4, so a 10 nt degenerate region implies a differentiator tag sequence complexity of ~1e6 species.

Hybridize Capture Probes to Human Genomic Sample

Assemble hybridization reaction:

1.0 ul capture probe mix (~2.5 pmol)
2.0 ul 10× Ampligase buffer (Epicentre)
6.0 ul 500 ng/ul human genomic DNA (~16.7 fmol) 11 ul dH2O In a thermal cycler, heat reaction to 95° C. for 5 min to denature genomic DNA, then cool to 60° C. Allow to incubate at 60° C. for 40 hours.

Convert Hybridized Probes into Covalently-Closed Circular Products Containing Subtargets Prepare fill-in/ligation reaction mixture:

0.25 ul 2 mM dNTP mix (Invitrogen)
2.5 ul 10× Ampligase buffer (Epicentre)
5.0 ul 5 U/ul Taq Stoffel fragment (Applied Biosystems)
12.5 ul 5 U/ul Ampligase (Epicentre)
4.75 ul dH2O Add 1.0 ul of this mix to the hybridized probe reaction, and incubate at 60° C. for 10 hours.

Purify Circularized Probe/Subtarget Products from Un-Reacted Probes and Genomic DNA Prepare exonuclease reaction mixture:

21 ul fill-in/ligation reaction product
2.0 ul 10× exonuclease I buffer (New England Biolabs)
2.0 ul 20 U/ul exonuclease I (New England Biolabs)
2.0 ul 100 U/ul exonuclease III (New England Biolabs)

Incubate at 37° C. for 60 min, then heat-inactivate by incubating at 80° C. for 15 min. Immediately cool to 4 C for storage.

Amplify Circular Material by PCR Using Primers Specific to the 'Constant Region' of the Probes Prepare PCR mixture:

5.0 ul 10× Accuprime reaction buffer (Invitrogen)

```
                                       (SEQ ID NO: 183)
1.5 ul 10 uM CP-2-FA    (5'-GCACGATCCGACGGTAGTGT-3')

(SEQ ID NO: 184)
1.5 ul 10 uM CP-2-RA    (5'-CCGTAATCGGGAAGCTGAAG-3')
```

0.4 ul 25 mM dNTP mix (Invitrogen)
2.0 ul heat-inactivated exonuclease reaction mix
1.5 ul 10× SybrGreen (Invitrogen)
0.4 ul 2.5 U/ul Accuprime Pfx polymerase (Invitrogen)
37.7 ul dH2O Thermal cycle in real-time thermal cycler according to the following protocol, but stop cycling before amplification yield plateaus (generally 8-12 cycles):

95C for 5 min 95C for 30 sec 58C for 60 sec 72C for 60 sec go to 2, N more times Prepare a shotgun next-generation sequencing library for analysis Purify desired amplicon population from non-specific amplification products by gel extraction.

Concatemerized amplicons into high-molecular weight products suitable for shearing Mechanically shear, using either a nebulizer, BioRuptor, Hydroshear, Covaris, or similar instrument. DNA should be sheared into fragments several hundred basepairs in length.

Ligate adapters required for amplification by the sequencing platform used. If necessary, purify ligated product from unligated product and adapters.

Perform Sequencing of Library According to Manufacturer's Directions (e.g. Illumina, ABI, etc), Reading Both the Target Sequence and the Differentiator Tag Sequence.

Analyze Data by Correcting for any Biases Detected by Quantitation of Differentiator Tag Sequence Abundance.

Construct a table of target:differentiator tag abundances from the read data, e.g.:

| Target ID | Differentiator tag sequence ID | Count |
|---|---|---|
| 1 | 3547 | 1 |
| 2 | 4762 | 1 |
| 1 | 9637 | 1 |
| 1 | 1078 | 5 |
| 3 | 4762 | 1 |
| 1 | 2984 | 1 |

All 'count' entries should be '1', since any particular target:differentiator tag mapping will not occur more than once by chance, and therefore will only be observed if bias was present somewhere in the sample preparation process. For any target:differentiator tag combination observed more than once, all such reads are 'collapsed' into a single read before consensus basecalls are determined. This will cancel the effect of bias on consensus basecall accuracy. FIG. 5 depicts a method for making diploid genotype calls in which repeat target:differentiator tag combination are collapsed.

Example 3

Differentiator Tag Sequence Design for MIP Capture Reactions

For a set of targets, the number of differentiator tag sequences necessary to be confident (within some statistical bounds) that a certain differentiator tag sequence will not be observed more than once by chance in combination with a certain target sequence was determined. The total number of unique differentiator tag sequences for a certain differentiator tag sequence length is determined as $4^{(Length\ in\ nucleotides\ of\ the\ differentiator\ tag\ sequence)}$. For a molecular inversion probe capture reaction that uses MIP probes having differentiator tag sequences, the probability of performing the capture reaction and capturing one or more copies of a target sequence having the same differentiator tag sequence is calculated as:

$p=1-[N!/(N-M)!]/[N^M]$, wherein N is the total number of possible unique differentiator tag sequences and M is the number of target sequence copies in the capture reaction. Thus, by varying the differentiator tag sequence length it is possible to perform a MIP capture reaction in which the probability of capturing one or more copies of a target sequence having the same differentiator tag sequence is set at a predetermined probability value.

For example, for a differentiator tag sequence of 15 nucleotides in length, there are 1,073,741,824 possible differentiator tag sequences. A MIP capture reaction in which MIP probes, each having a differentiator tag sequence of 15 nucleotides, are combined with 10000 target sequence copies (e.g., genome equivalents), the probability of capturing one or more copies of a target sequence having the same differentiator tag sequence is 0.05. In this example, the MIP reaction will produce very few (usually 0, but occasionally 1 or more) targets where multiple copies are tagged with the same differentiator tag sequence. FIG. 6 depicts results of a simulation for 100000 capture reactions having 15 nucleotide differentiator tag sequences and 10000 target sequences.

Example 4

Assessment of the Probability for Obtaining Enough Sequencing Reads to Make Accurate Base-Calls at Multiple Independent Loci, as a Function of Sequencing Coverage.

Monte Carlo simulations were performed to determine sequencing coverage requirements. The simulations assume 10000 genomic copies of a given locus (target) half mom alleles and half dad alleles. The simulations further assume 1% efficiency of capture for the MIP reaction. The simulation samples from a capture mix 100 times without replacement to create a set of 100 capture products. The simulation then samples from the set of 100 capture products with replacement (assuming unbiased amplification) to generate 'reads' from either mom or dad. The number of reads sampled depends on the coverage. The number of independent reads from both mom and dad necessary to make a high-quality base-call (assumed to be 10 or 20 reads) were then determined. The process was repeated 1000 times for each coverage level, and the fraction of times that enough reads from both parents were successfully obtained was determined. This fraction was raised to the power 1000, assuming we have 1000 independent loci that must obtain successful base-calls, plotted (See FIG. 7). Result show that roughly 50× coverage is required to capture each allele >=10× with >0.95 probability.

Example 5

MIP Capture of 'Target' Locus and 'Control' Loci

In some embodiments, to accurately quantify the efficiency of target locus capture, at least three sets of control loci are captured in parallel that have a priori been shown to serve as proxies for various lengths of target locus. For example, if the target locus is expected to have a length between 50 and 1000 bp, then sets of control loci having lengths of 50, 250, and 1000 bp could be captured (e.g. 20 loci per set should provide adequate protection from outliers), and their abundance digitally measured by sequencing. These loci should be chosen such that minimal variation in efficiency between samples and on multiple runs of the same sample is observed (and are therefore 'efficiency invariant'). These will serve as 'reference' points that define the shape of the curve of abundance-vs-length. Determining the length of the target is then simply a matter of 'reading' the length from the appropriate point on the calibration curve.

In some embodiments, the statistical confidence one has in the estimate of target length from this method is driven largely by three factors: 1) reproducibility/variation of the abundance data used to generate the calibration curve; 2) goodness of fit of the regression to the 'control' datapoints; 3) reproducibility of abundance data for the target locus being measured. Statistical bounds on 1) and 2) will be known in advance, having been measured during development of the assay. Additionally, statistical bounds on 3) will be known in general in advance, since assay development should include adequate population sampling and measure of technical reproducibility. Standard statistical methods should be used to combine these three measures into a single P value for any given experimental measure of target abundance.

In some embodiments, given the set of calibration observations, and a linear regression fit to that data, the regression can be used to predict the length value for n observations of the target locus whose length is unknown. First, choose an acceptable range for the confidence interval of the length estimate. For example, in the case of distinguishing "normal" (87-93 bp) from "premutation" (165-600 bp) potential cases of Fragile X, the goal is to measure length to sufficient precision to distinguish 93 bp from 165 bp. The predicted response value, computed when n observations is substituted into the equation for the regressed line, will have arbitrary precision. However, if for example a 95% confidence level is desired, that 95% confidence interval must be sufficiently short that it does not overlap both the "normal" and "premutation" length ranges. Continuing the example, if one calculates a length of 190 from n=400 MIP observations, and based on the regression from calibration data, the 95% confidence interval is 190+/−20 bp, one can conclude the sample represents a "premutation" length with 95% certainty. Conversely, if the calibration data were less robust, error estimates of the regression would be higher, leading to larger confidence intervals on the predicted response value. In some embodiments, if the 95% CI were calculated as 190+/−100 bp from n=400, one could not determine whether the predicted response value corresponds to a "normal" or "premutation" length.

In some embodiments, the confidence interval for a predicted response is calculated as:

The estimate for the response ŷ is identical to the estimate for the mean of the response: $\tilde{y} = b_0 + b_1 x^*$. The confidence interval for the predicted value is given by ŷ±t*sŷ, where ŷ is the fitted value corresponding to x*. The value t* is the upper (1−C)/2 critical value for the t(n−2) distribution.

In some embodiments, a technique for analyzing a locus of interest can involve the following steps.

Convert Hybridized Probes into Covalently-Closed Circular Products Containing Subtargets
Prepare fill-in/ligation reaction mixture:
0.25 ul 2 mM dNTP mix (Invitrogen)
2.5 ul 10× Ampligase buffer (Epicentre)
5.0 ul 5 U/ul Taq Stoffel fragment (Applied Biosystems)
12.5 ul 5 U/ul Ampligase (Epicentre)
4.75 ul dH2O
Add 1.0 ul of this mix to the hybridized probe reaction, and incubate at 60° C. for 10 hours.

Purify Circularized Probe/Subtarget Products from Un-Reacted Probes and Genomic DNA
Prepare exonuclease reaction mixture:
21 ul fill-in/ligation reaction product
2.0 ul 10× exonuclease I buffer (New England Biolabs)
2.0 ul 20 U/ul exonuclease I (New England Biolabs)
2.0 ul 100 U/uI exonuclease III (New England Biolabs)
Incubate at 37° C. for 60 min, then heat-inactivate by incubating at 80° C. for 15 min. Immediately cool to 4 C for storage.

Amplify Circular Material by PCR Using Primers Specific to the 'Constant Region' of the Probes
Prepare PCR mixture:
5.0 ul 10× Accuprime reaction buffer (Invitrogen)
1.5 ul 10 uM CP-2-FA-Ilmn (platform-specific amplification sequence plus 'circle constant region'-specific sequence)
1.5 ul 10 uM CP-2-RA-Ilmn (platform-specific amplification sequence plus 'circle constant region'-specific sequence)
0.4 ul 25 mM dNTP mix (Invitrogen)
2.0 ul heat-inactivated exonuclease reaction mix
1.5 ul 10× SybrGreen (Invitrogen)
0.4 ul 2.5 U/ul Accuprime Pfx polymerase (Invitrogen)
37.7 ul dH2O
Thermal cycle in real-time thermal cycler according to the following protocol, but stop cycling before amplification yield plateaus (generally 8-12 cycles):
95C for 5 min 95C for 30 sec 58C for 60 sec 72C for 60 sec
go to 2, N more times
Perform Sequencing (e.g., Next-Generation Sequencing) on Sample for Digital Quantitation According to Manufacturer's Instructions (e.g., Illumina, Abi)

Example 6

MIP-Capture Reaction of a Set of Exon Target Nucleic Acids
MIP probes are synthesized using standard column-based oligonucleotide synthesis by any number of vendors (e.g. IDT).
Hybridize Capture Probes to Human Genomic Sample
Assemble hybridization reaction:
1.0 ul capture probe mix (~2.5 pmol)
2.0 ul 10× Ampligase buffer (Epicentre)
6.0 ul 500 ng/ul human genomic DNA (~16.7 fmol) 11 ul dH2O
In a thermal cycler, heat reaction to 95° C. for 5 min to denature genomic DNA, then cool to 60° C. Allow to incubate at 60° C. for 40 hours.

Convert Hybridized Probes into Covalently-Closed Circular Products Containing Target Nucleic Acids
Prepare fill-in/ligation reaction mixture:
0.25 ul 2 mM dNTP mix (Invitrogen)
2.5 ul 10× Ampligase buffer (Epicentre)
5.0 ul 5 U/ul Taq Stoffel fragment (Applied Biosystems)
12.5 ul 5 U/ul Ampligase (Epicentre)
4.75 ul dH2O
Add 1.0 ul of this mix to the hybridized probe reaction, and incubate at 60° C. for 10 hours.

Purify circularized probe/target nucleic acid products from un-reacted probes and genomic DNA
Prepare exonuclease reaction mixture:
21 ul fill-in/ligation reaction product
2.0 ul 10× exonuclease I buffer (New England Biolabs)
2.0 ul 20 U/ul exonuclease I (New England Biolabs)
2.0 ul 100 U/ul exonuclease III (New England Biolabs)
Incubate at 37° C. for 60 min, then heat-inactivate by incubating at 80° C. for 15 min. Immediately cool to 4° C. for storage.

Amplify Circular Material by PCR Using Primers Specific to the 'Constant Region' of the Probes
Prepare PCR mixture:
5.0 ul 10× Accuprime reaction buffer (Invitrogen)

```
                                            (SEQ ID NO: 183)
1.5 ul 10 uM CP-2-FA    (5'-GCACGATCCGACGGTAGTGT-3')

(SEQ ID NO: 184)
1.5 ul 10 uM CP-2-RA    (5'-CCGTAATCGGGAAGCTGAAG-3')
```

0.4 ul 25 mM dNTP mix (Invitrogen)
2.0 ul heat-inactivated exonuclease reaction mix
1.5 ul 10× SybrGreen (Invitrogen)
0.4 ul 2.5 U/ul Accuprime Pfx polymerase (Invitrogen)
37.7 ul dH2O
Thermal cycle in real-time thermal cycler according to the following protocol, but stop cycling before amplification yield plateaus (generally 8-12 cycles):
95° C. for 5 min
95° C. for 30 sec
58° C. for 60 sec
72° C. for 60 sec
go to 2, N more times Prepare a Shotgun Next-Generation Sequencing Library for Analysis
Purify desired amplicon population from non-specific amplification products by gel extraction.
Concatemerized amplicons into high-molecular weight products suitable for shearing Mechanically shear, using either a nebulizer, BioRuptor, Hydroshear, Covaris, or similar instrument. DNA should be sheared into fragments several hundred basepairs in length.
Ligate adapters required for amplification by the sequencing platform used. If necessary, purify ligated product from unligated product and adapters.
Perform Sequencing of Library According to Manufacturer's Directions (e.g. Illumina, ABI, etc), Reading the Target Sequence to Determine Abundance of the Target Nucleic Acid.

Example 7

Use of MIPs, Hybridization, and Mutation-Detection MIPs to Genotype a Set of 1000 Targets MIPs, hybridization, and mutation-detection MIPs are used to genotype a set of 1000 targets. The protocol permits detection of any of 50 specific known point mutations First, separate MIP, hybridization, and mutation-detection MIP reactions are performed on a biological sample. A MIP capture reaction is performed essentially as described in Turner et al 2009, Nature methods 6:315-6. A set of MIPs is designed such to that each probe in the set flanks one of the 1000 targets. Separately, a hybridization enrichment reaction is performed using the Agilent SureSelect procedure. Prior to selection, the genomic DNA to be enriched is converted into a shotgun sequencing library using Illumina's 'Fragment Library' kit and protocol. Agilent's web interface is used to design a set of probes which will hybridize to the target nucleic acids. Separately, a set of probes are designed (mutation-detection MIPs) which will form MIPs only if mutations (e.g., specific polymorphisms) are present. Each mutation-detection MIP has a 3'-most base identity that is specific for a single known mutation. A reaction with this set of mutation-detection MIPs is performed to selectively detect the presence of any mutant alleles.

Once all three reactions have been performed, the two MIP reactions are combined (e.g., at potentially non-equimolar ratios to further increase sensitivity of mutation detection) into a single tube, and run as one sample on the next-generation DNA sequencing instrument. The hybridization-enriched reaction is run as a separate sample on the next-generation DNA sequencing instrument. Reads from each 'sample' are combined by a software algorithm which forms a consensus diploid genotype at each position in the target set by evaluating the total coverage at each position, the origin of each read in that total coverage, the quality score of each individual read, and the presence (or absence) of any reads derived from mutation-specific MIPs overlapping the region.

Example 8

Carrier screening is performed either pre-conception or during pregnancy to determine a couple's risk of having a child with a recessive genetic disorder. The number of individuals who could benefit from such screening is substantial, as roughly 2 million women give birth to their first child each year in the US. The disorders for which testing is recommended vary based on a number of different patient-specific factors. For instance, the American Congress of Obstetricians and Gynecologists recommends that screening for cystic fibrosis be offered to all women of reproductive age, and that testing be performed for additional disorders if indicated by family history, partner's carrier status, or ethnicity.

Today, carrier screening is typically performed using focused genotyping technologies that are designed to interrogate specific mutations within a gene of interest. However, because of cost and complexity, these tests often do not include all known disease causing mutations. In contrast, next-generation DNA sequencing (NGS) can comprehensively genotype a set of genes in a cost-efficient manner, and is therefore poised to supplant current technologies for routine, high-volume carrier screening.

For NGS to be used for carrier screening in a clinical setting, it must satisfy at least three requirements. First, analytical accuracy must be both high and well characterized within the clinically relevant genes or regions. Previous reports have demonstrated a broad range of accuracy values, and in some cases it is unclear whether these values hold within the relevant regions of the genome. In addition, accuracy for insertions and deletions is generally either substantially lower or uncharacterized, and measured to lower precision. Second, the NGS workflow employed should yield data sufficient to cover the vast majority of targeted bases at a depth sufficient to make high-quality genotype calls. It has been noted, however, that the percentage of bases callable at a given depth varies widely with both the sample preparation workflow and the total amount of sequencing 8,10. Finally, the workflow must be highly robust and reproducible, which can often be achieved through automation. However, typical NGS sample preparation workflows are not amenable to high-throughput automation because of rate-limiting mechanical shearing, reaction purifications, size selections, and kitted reagent costs (typically $50-$200 per sample).

The following is an integrated NGS workflow that meets these requirements for carrier screening. The workflow combines automated, optimized molecular inversion probe target capture with molecular barcoding to maximize the sample throughput of a next-generation DNA sequencing machine, and employs a novel read assembly-based alignment method that enables accurate identification of both substitution and insertion/deletion lesions. The workflow is applied to sequence the protein-coding regions of fifteen genes in which loss-of-function mutations cause recessive Mendelian disorders often included as part of routine carrier screening, and demonstrate through realistic simulation and comparison to Sanger sequencing data that our approach achieves high accuracies.

METHODS AND MATERIALS

Molecular Inversion Probe Design

Molecular inversion probes were designed to capture the coding regions and certain well-characterized non-coding regions of 15 genes (See Table 5 below). The 5' targeting arm (ligation arm) and 3' targeting arm (extension arm) comprised a total of 40 nucleotides and were designed to flank 130 bp target regions. Probes were selected to maximize performance with respect to both capture efficiency and robustness to common polymorphisms. All possible probes targeting a genomic interval were designed and assigned score tuples consisting of: 1) presence of guanine or cytosine as the 5'-most base of the ligation arm, 2) the number of dbSNP (version 130) entries intersecting targeting arm sites, and 3) the root mean squared deviation of the arms' predicted melting temperatures from optimal values derived from empirical studies of capture efficiency.

Using these tuples, probes were ranked sequentially by 1, 2, and 3, and the probe with the highest rank was chosen. Probes were designed to 'tile' across targets with a period of 25 bp such that multiple probes with orthogonal targeting arm sequences captured every genomic position. The molecular inversion probes are provided in Appendix A. Appendix A also includes the upstream and downstream regions corresponding to each molecular inversion probe, which is shown by the start position and end position coordinates of each targeting arm relative to the target sub-region's coordinates on the Human Genome 18 (HG 18). Appendix B lists the genomic sub-regions targeted by the molecular inversion probes of Appendix A.

Table 5 shows diseases and genes the workflow is designed to interrogate, and the corresponding genes and nucleotides targeted.

TABLE 5

| DISEASE | OMIM ID | GENE | NT TARGETED |
|---|---|---|---|
| Familial hyperinsulinism | 256450 | ABCC8 | 5,808 |
| Canavan disease | 271900 | ASPA | 1,062 |
| Maple syrup urine disease type 1a/1b | 248600 | BCKDHA | 1,518 |
|  |  | BCKDHB | 1,379 |
| Bloom syndrome | 210900 | BLM | 4,674 |
| Cystic fibrosis | 219700 | CFTR | 5,444 |
| Usher syndrome type IIIA | 276902 | CLRN1 | 856 |
| Dihydrolipoamide dehydrogenase deficiency | 248600 | DLD | 1,810 |
| Fanconi anemia group C | 227645 | FANCC | 1,957 |
| Glycogen storage disease type 1a | 232200 | G6PC | 1,174 |
| Tay-Sachs disease | 272800 | HEXA | 1,870 |
| Familial dysautonomia | 223900 | IKBKAP | 4,719 |
| Mucolipidosis type IV | 252650 | MCOLN1 | 2,023 |
| Usher syndrome type IF | 602083 | PCDH15 | 6,508 |
| Niemann-Pick disease type A/B | 257200/ 607616 | SMPD1 | 2,056 |
|  |  | TOTAL | 42,858 |

Target Capture, Barcoding, and NGS

Genomic DNA was purchased from the Coriell Cell Repositories (Camden, NJ) or isolated from whole blood by the Gentra Puregene method (Qiagen) modified to conclude with an overnight incubation at 65° C. Overnight incubation at an elevated temperature led to DNA shearing and an increased fraction of callable bases. All samples were considered "IRB Exempt" by Liberty IRB, our independent Institutional Review Board. On Tecan automation, 1.5 ug of genomic DNA was annealed with 1 ul of molecular inversion probe mix in 1× Ampligase buffer (Epicentre Biotechnologies) for 5 min at 95° C. followed by 24 hr at 54° C. 17 ul of fill-in mix (4 U Taq Stoffel fragment [Life Technologies], 10 U Ampligase [Epicentre Biotechnologies], 23.1 uM dNTP mix) was added by Tecan automation and incubated for 1 hr at 54° C. 50 U Exonuclease I and 50 U Exonuclease III (Enzymatics Inc.) were then added by Tecan automation and incubated for 1 hr at 37° C. followed by 10 min at 98° C. The capture reaction product was amplified in two separate PCR reactions designed to attach a molecular barcode and Illumina cluster amplification sequences to the ends of each molecule so as to enable sequencing from each end of the captured region. Tecan automation was used to set up the PCR, which was carried out with 3.75 ul of capture product, 15 pmol of each primer, 10 nmol dNTPs, and 1 U VeraSeq polymerase (Enzymatics, Inc) in 1× Veraseq buffer. Cycling conditions were: 98° C. 30 see, 17-22× (98° C. 10 sec, 54° C. 30 see, 72° C. 15 sec), 4° C. forever.

Following PCR, equal volumes of product from multiple samples were pooled using Tecan automation, then purified using a Qiaquick column (Qiagen). The library pool concentration was quantified on a Bioanalyzer 2100 (Agilent Technologies) and diluted to 10 nM. Single-read sequencing (85 bp for genomic tag and 15 bp for barcode/index) was performed on the Hiseq 2000 (Illumina, Inc) according to the manufacturer's instructions. Each pool of libraries was sequenced in 7 lanes, with the 8th lane used for the manufacturer-supplied PhiX control library.

NGS Data Analysis with Alignment Only Algorithm

Raw.bcl files were converted to qseq files using bclConverter (Illumina). Fastq files were generated by 'de-barcoding' genomic reads using the associated barcode reads; reads for which barcodes yielded no exact match to an expected barcode, or contained one or more low-quality basecalls, were discarded. The remaining reads were aligned to hg18 on a per-sample basis using BWA version 0.5.7 for short alignments and genotype calls were made using GATK version 1.0.4168 after base quality score re-calibration, realignment (with GATK version 1.0.5083) and targeting arm removal. High-confidence genotype calls were defined as having depth >=50 and strand bias score<=0. Clinical significance of variant calls was determined by matching against a VCF-formatted database of disease-causing mutations curated from the literature, with equivalent insertion/deletion regions calculated as previously described.

NGS Data Analysis with Genotyping by Assembly-Templated Alignment Algorithm

De-barcoded fastq files were obtained as described above and partitioned by capture region (exon) using the target arm sequence as a unique key. Reads were assembled in parallel by exon using SSAKE version 3.7 with parameters "-m 30-o 15". The resulting contigs were aligned to hg18 using BWA version 0.5.7 for long alignments with parameter "-r 1". Short read alignment was performed as described above except that sample contigs (rather than hg18) were used as the input reference sequence. Software was developed in Java to accurately transfer coordinate and variant data (gaps) from local sample space to global reference space for every BAM-formatted alignment. Genotyping and base quality recalibration were performed on the coordinate-translated BAM files using GATK version 1.6.5.

Sanger Sequencing

PCR was carried out with the genomic DNA described in Target capture, barcoding, and NGS using a modified version of the protocol from Zimmerman et al., using PCR primers from Jones et al., except M13 tails were removed. See Zimmerman R S, Cox S, Lakdawala N K, et al. A novel custom resequencing array for dilated cardiomyopathy. Genet Med. May 2010; 12(5): 268-278; Jones S, Zhang X, Parsons D W, et al. Core signaling pathways in human pancreatic cancers revealed by global genomic analyses. Science. Sep. 2008; 321(5897):1801-1806.

Briefly, 15 ul reactions were performed with 25 ng of genomic DNA, 1U of AmpliTaq Gold (Applied Biosystems), and 10 fmol of each PCR primer in a PCR mix containing 4.8% DMSO (v/v), IM betaine, 2.5 mM magnesium chloride, 1 uM dNTPs (total), and 1× GeneAmp PCR Gold Buffer (Applied Biosystems). Cycling conditions were: 95° C. 10 min, 30×(95° C. 30 see, 60° C. 30 sec, 72° C. 30 sec), 72° C. 10 min, 8° C. forever. PCR products were sent to either Beckman Coulter Genomics or Genewiz where cleanup and chain termination bi-directional Sanger sequencing was performed on an ABI 3730xl according to standard protocols. Data was retrieved in electropherogram (abl) format.

Sanger Data Analysis and Cross-Validation to NGS

Mutation Surveyor software ("MS", Softgenetics) version 4.0.5 was used in batch-mode with default parameters to align abl files to target reference sequence and make genotype calls. Positions where MS base calls did not match in the forward and reverse directions were removed from consideration. All high-quality NGS genotype calls within 10 bp (inclusive) of target exons were subjected to cross-validation against VCF-converted MS variant calls. This process is described in more detail below.

Calls were compared by (i) lesion type (substitution, insertion, deletion, or combination thereof), (ii) lesion pattern (sequence difference compared to the reference), and (iii) genomic position (or equivalent position for insertions and deletions). NGS calls were classified true positive (TP), discordant (non-reference) variant genotype (DVG), or false positive (FP) if they matched MS calls by (i-iii), (iii) only, or none of the above criteria, respectively. MS variant calls with no corresponding NGS variant call were classified false negative (FN). Indel calls classified as DVG were reclassified as TP because GATK 1.0.4168 does not report zygosity for such calls. All concordant reference calls were considered true negative (TN). Each discordant call (DVG, FP, and FN), along with a subset of concordant calls, was subject to expert manual review and discarded or reclassified as appropriate. False positive rate was calculated as FP/(FP+TN).

False negative rate was calculated as FN/(FN+TP). Compound heterozygous NGS calls (two different non-reference alleles) were cross-validated against Sanger data manually by aligning traces to a reference manipulated to contain one of the two variant alleles. In these cases TP genotype calls were reported as simple heterozygous by MS.

Assessment of Detectability of Clinical Mutations by Simulation

145 Coriell samples were sequenced and analyzed by Genotyping by Assembly-Templated Alignment (GATA, described above). Applications were developed in Java and Groovy to input aligned reads (BAM records) from each sample and manipulate specific data fields (base sequence and qualities) to resemble the appropriate DNA lesion pattern of a given clinically relevant mutation. To simulate heterozygous carriers input reads covering the mutation were chosen at random for sequence manipulation with an average probability of 0.5. All reads, whether manipulated or not, were output in fastq format for subsequent GATA analysis as described. This process was repeated for each of 81 mutations of clinical significance whereupon genotyped (observed) alleles were cross-referenced back to the original simulated (expected) allele. Samples for which the allele was already present were excluded from simulation (e.g. many Coriell samples in the set contained the common CFTR F508del mutation). Mutations with detection rates <100% between the expected and observed alleles were classified as undetectable by NGS.

Determining Clinical Significance of Variant Allele Calls

Each NOS-detected variant allele is annotated for functional (clinical) significance by determining its relative position within the corresponding consensus coding sequence (CCDS). For the genes under consideration here these are: PCDH15 (CCDS7248.1), SMPD1 (CCDS44531.1), ABCC8 (CCDS31437.1), HEXA (CCDS10243.1), BLM (CCDS10363.1), ASPA (CCDS11028.1), G6PC (CCDS11446.1), MCOLN1 (CCDS12180.1), BCKDHA (CCDS12581.1), CLRN1 (CCDS3153.1), BCKDHB (CCDS4994.1), DLD (CCDS5749.1), CFTR (CCDS5773.1), FANCC (CCDS35071.1), and IKBKAP (CCDS6773.1). Clinically significant (reportable) mutations include alterations to the conserved 2 basepairs flanking each exon (splice site), the native start codon, or the last codon (readthrough), as well as truncating (nonsense and frameshift) mutations. Additionally, GATK occasionally reports alternate insertion patterns with non-native bases (e.g. 'N') chosen from a minority of reads. These were classified 'indeterminate' and reportable to prompt follow-up confirmation.

Results i. Completeness and Reproducibility

Automated target capture and molecular barcoding were performed followed by NGS on a set of 194 samples derived from immortalized cell lines (55 containing specific disease-causing mutations, and 139 chosen to represent ethnic diversity) and 59 samples derived from whole blood (as shown in Table 6 below). All exons were targeted including 10 nt of flanking intronic sequence, plus additional intronic regions known to contain disease-causing mutations in 15 genes causative of 14 recessive Mendelian diseases (Table 5) using tiling molecular inversion probes (see Methods). A total of 25,907,612,945 basepairs of de-multiplexed sequence were generated, corresponding to an average per-base coverage per sample of 2,399× (m 891×, max 4,000×). Out of the 42,858 bases targeted for capture in each sample, we made high-confidence genotype calls at an average of 97.3% (m 92.2%, max 99.8%) for cell line-derived DNA and 99.9% (m 99.8%, max 99.9%) for blood-derived DNA (See Table 5 above).

Table 6 shows the set of 94 samples derived from immortalized cell lines and 59 samples derived from whole blood.

TABLE 6

| Sample ID | Sample Source | Sample Type | Sequence (raw bp) | Average Coverage | Percentage of Bases >= 50X | Reproducibility ? | Sanger Concordance ? |
|---|---|---|---|---|---|---|---|
| GM00502 | Cell line | Disease | 76,288,149 | 1,787 | 97.6 | Yes | Yes |
| GM00649 | Cell line | Disease | 115,317,695 | 2,701 | 97.9 | Yes | Yes |
| GM00650 | Cell line | Disease | 69,572,569 | 1,629 | 93.1 | Yes | Yes |
| GM01531 | Cell line | Disease | 93,831,687 | 2,198 | 99.2 | Yes | Yes |
| GM02533 | Cell line | Disease | 61,190,070 | 1,433 | 98.6 | Yes | Yes |
| GM02828 | Cell line | Disease | 49,081,409 | 1,150 | 98.6 | Yes | Yes |
| GM03252 | Cell line | Disease | 47,780,116 | 1,119 | 98.9 | Yes | Yes |
| GM03461 | Cell line | Disease | 133,932,433 | 3,137 | 95.2 | Yes | Yes |
| GM04268 | Cell line | Disease | 113,557,310 | 2,660 | 98.6 | Yes | Yes |
| GM04330 | Cell line | Disease | 115,608,790 | 2,708 | 94.3 | Yes | Yes |
| GM05042 | Cell line | Disease | 113,811,449 | 2,666 | 96.0 | Yes | Yes |
| GM06966 | Cell line | Disease | 51,321,434 | 1,202 | 99.0 | Yes | Yes |

TABLE 6-continued

| Sample ID | Sample Source | Sample Type | Sequence (raw bp) | Average Coverage | Percentage of Bases >= 50X | Reproducibility? | Sanger Concordance? |
|---|---|---|---|---|---|---|---|
| GM07381 | Cell line | Disease | 87,834,174 | 2,057 | 99.3 | Yes | Yes |
| GM07441 | Cell line | Disease | 108,471,717 | 2,541 | 99.4 | Yes | Yes |
| GM07552 | Cell line | Disease | 106,594,630 | 2,497 | 99.3 | Yes | Yes |
| GM07732 | Cell line | Disease | 137,685,131 | 3,225 | 94.7 | Yes | Yes |
| GM07857 | Cell line | Disease | 98,376,083 | 2,304 | 96.6 | Yes | Yes |
| GM08338 | Cell line | Disease | 131,459,591 | 3,079 | 96.9 | Yes | Yes |
| GM11275 | Cell line | Disease | 119,881,299 | 2,808 | 99.3 | Yes | Yes |
| GM11277 | Cell line | Disease | 85,993,084 | 2,014 | 99.3 | Yes | Yes |
| GM11278 | Cell line | Disease | 125,921,303 | 2,949 | 92.9 | Yes | Yes |
| GM11280 | Cell line | Disease | 121,485,712 | 2,845 | 99.2 | Yes | Yes |
| GM11281 | Cell line | Disease | 107,022,433 | 2,507 | 99.7 | No | Yes |
| GM11282 | Cell line | Disease | 105,909,029 | 2,481 | 99.5 | Yes | Yes |
| GM11283 | Cell line | Disease | 128,624,241 | 3,013 | 96.5 | Yes | Yes |
| GM11284 | Cell line | Disease | 125,265,008 | 2,934 | 99.8 | Yes | Yes |
| GM11285 | Cell line | Disease | 105,205,580 | 2,464 | 97.3 | Yes | Yes |
| GM11287 | Cell line | Disease | 121,267,787 | 2,840 | 96.4 | Yes | Yes |
| GM11288 | Cell line | Disease | 116,071,397 | 2,719 | 98.0 | Yes | Yes |
| GM11370 | Cell line | Disease | 106,105,647 | 2,485 | 95.9 | Yes | Yes |
| GM11468 | Cell line | Disease | 120,852,669 | 2,831 | 97.9 | Yes | Yes |
| GM11472 | Cell line | Disease | 146,901,682 | 3,441 | 97.0 | Yes | Yes |
| GM11496 | Cell line | Disease | 119,104,149 | 2,790 | 99.3 | Yes | Yes |
| GM11497 | Cell line | Disease | 103,338,594 | 2,420 | 99.0 | Yes | Yes |
| GM11723 | Cell line | Disease | 111,446,565 | 2,610 | 99.1 | Yes | Yes |
| GM11859 | Cell line | Disease | 132,558,321 | 3,105 | 99.7 | Yes | Yes |
| GM11860 | Cell line | Disease | 133,241,170 | 3,121 | 99.5 | Yes | Yes |
| GM12444 | Cell line | Disease | 112,979,130 | 2,646 | 99.3 | Yes | Yes |
| GM12585 | Cell line | Disease | 142,275,400 | 3,332 | 98.4 | Yes | Yes |
| GM12785 | Cell line | Disease | 77,781,835 | 1,822 | 99.0 | Yes | Yes |
| GM12960 | Cell line | Disease | 105,134,323 | 2,462 | 99.2 | Yes | Yes |
| GM13205 | Cell line | Disease | 116,426,912 | 2,727 | 97.0 | Yes | Yes |
| GM13423 | Cell line | Disease | 142,163,141 | 3,330 | 96.5 | Yes | Yes |
| GM13591 | Cell line | Disease | 127,607,783 | 2,989 | 98.6 | Yes | Yes |
| GM16193 | Cell line | Disease | 80,190,257 | 1,878 | 92.7 | Yes | Yes |
| GM17023 | Cell line | HuVar | 114,118,598 | 2,673 | 98.9 | No | Yes |
| GM17074 | Cell line | TGP | 125,212,956 | 2,933 | 98.5 | No | Yes |
| GM17075 | Cell line | TGP | 114,067,841 | 2,672 | 95.1 | No | Yes |
| GM17078 | Cell line | TGP | 135,956,925 | 3,184 | 97.3 | No | Yes |
| GM17079 | Cell line | TGP | 109,131,650 | 2,556 | 93.8 | No | Yes |

TABLE 6-continued

| Sample ID | Sample Source | Sample Type | Sequence (raw bp) | Average Coverage | Percentage of Bases >= 50X | Reproducibility? | Sanger Concordance? |
|---|---|---|---|---|---|---|---|
| GM17080 | Cell line | TGP | 104,079,000 | 2,438 | 98.2 | No | Yes |
| GM17203 | Cell line | HuVar | 100,286,170 | 2,349 | 95.8 | No | Yes |
| GM17207 | Cell line | HuVar | 133,095,165 | 3,117 | 99.7 | No | Yes |
| GM17228 | Cell line | HuVar | 75,792,351 | 1,775 | 98.7 | No | Yes |
| GM17231 | Cell line | HuVar | 138,157,418 | 3,236 | 97.1 | No | Yes |
| GM17233 | Cell line | HuVar | 115,522,256 | 2,706 | 97.1 | No | Yes |
| GM17242 | Cell line | HuVar | 114,147,392 | 2,673 | 99.3 | No | Yes |
| GM17247 | Cell line | HuVar | 88,905,331 | 2,082 | 99.3 | No | Yes |
| GM17251 | Cell line | HuVar | 134,029,728 | 3,139 | 97.8 | No | Yes |
| GM17282 | Cell line | HuVar | 104,284,777 | 2,443 | 95.5 | Yes | Yes |
| GM17286 | Cell line | HuVar | 124,885,886 | 2,925 | 98.0 | No | Yes |
| GM17301 | Cell line | HuVar | 115,253,375 | 2,699 | 95.5 | Yes | Yes |
| GM17302 | Cell line | HuVar | 126,663,091 | 2,967 | 95.6 | Yes | Yes |
| GM17303 | Cell line | HuVar | 148,723,815 | 3,483 | 96.8 | No | Yes |
| GM17304 | Cell line | HuVar | 140,507,360 | 3,291 | 95.3 | No | Yes |
| GM17310 | Cell line | HuVar | 112,930,123 | 2,645 | 96.5 | No | Yes |
| GM17315 | Cell line | HuVar | 146,713,295 | 3,436 | 96.0 | Yes | Yes |
| GM17317 | Cell line | HuVar | 120,214,964 | 2,816 | 96.1 | No | Yes |
| GM17318 | Cell line | HuVar | 131,177,753 | 3,072 | 98.4 | Yes | Yes |
| GM17319 | Cell line | HuVar | 74,599,530 | 1,747 | 96.3 | Yes | Yes |
| GM17320 | Cell line | HuVar | 143,908,026 | 3,371 | 98.9 | Yes | Yes |
| GM17360 | Cell line | HuVar | 72,217,715 | 1,691 | 99.3 | Yes | Yes |
| GM17361 | Cell line | HuVar | 138,241,789 | 3,238 | 97.5 | No | Yes |
| GM17362 | Cell line | HuVar | 109,391,827 | 2,562 | 95.4 | Yes | Yes |
| GM17363 | Cell line | HuVar | 136,216,563 | 3,190 | 97.4 | No | Yes |
| GM17364 | Cell line | HuVar | 124,580,794 | 2,918 | 98.8 | Yes | Yes |
| GM17365 | Cell line | HuVar | 145,974,763 | 3,419 | 96.8 | Yes | Yes |
| GM17366 | Cell line | HuVar | 121,059,291 | 2,835 | 95.3 | Yes | Yes |
| GM17367 | Cell line | HuVar | 124,286,280 | 2,911 | 97.7 | Yes | Yes |
| GM17368 | Cell line | HuVar | 122,309,228 | 2,865 | 97.4 | Yes | Yes |
| GM17369 | Cell line | HuVar | 151,606,788 | 3,551 | 97.2 | No | Yes |
| GM17392 | Cell line | HuVar | 120,466,852 | 2,822 | 96.9 | Yes | Yes |
| GM17393 | Cell line | HuVar | 129,362,199 | 3,030 | 96.1 | Yes | Yes |
| GM17394 | Cell line | HuVar | 133,049,780 | 3,116 | 96.4 | No | Yes |
| GM17395 | Cell line | HuVar | 145,469,089 | 3,407 | 97.0 | No | Yes |
| GM17396 | Cell line | HuVar | 131,796,124 | 3,087 | 96.1 | No | Yes |
| GM17962 | Cell line | HapMap | 110,772,396 | 2,594 | 92.3 | Yes | Yes |
| GM17965 | Cell line | HapMap | 131,430,391 | 3,078 | 95.4 | No | Yes |

TABLE 6-continued

| Sample ID | Sample Source | Sample Type | Sequence (raw bp) | Average Coverage | Percentage of Bases >= 50X | Reproducibility? | Sanger Concordance? |
|---|---|---|---|---|---|---|---|
| GM17966 | Cell line | HapMap | 108,405,815 | 2,539 | 92.6 | No | Yes |
| GM17967 | Cell line | HapMap | 133,849,482 | 3,135 | 95.2 | Yes | Yes |
| GM17968 | Cell line | HapMap | 104,839,659 | 2,455 | 96.0 | Yes | Yes |
| GM17969 | Cell line | HapMap | 170,762,900 | 4,000 | 98.7 | Yes | Yes |
| GM17970 | Cell line | HapMap | 129,700,472 | 3,038 | 96.5 | Yes | Yes |
| GM17971 | Cell line | HapMap | 146,346,722 | 3,428 | 97.2 | Yes | Yes |
| GM17972 | Cell line | HapMap | 139,495,486 | 3,267 | 96.2 | Yes | Yes |
| GM17973 | Cell line | HapMap | 116,085,421 | 2,719 | 93.2 | No | Yes |
| GM18015 | Cell line | HuVar | 120,955,000 | 2,833 | 95.2 | No | Yes |
| GM18017 | Cell line | HuVar | 128,904,006 | 3,019 | 96.0 | Yes | Yes |
| GM18034 | Cell line | HuVar | 104,807,682 | 2,455 | 97.4 | Yes | Yes |
| GM18043 | Cell line | HuVar | 117,441,953 | 2,751 | 95.4 | No | Yes |
| GM18044 | Cell line | HuVar | 149,341,518 | 3,498 | 96.8 | No | Yes |
| GM18067 | Cell line | HuVar | 90,615,125 | 2,122 | 94.3 | Yes | Yes |
| GM18073 | Cell line | HuVar | 120,359,154 | 2,819 | 94.0 | No | Yes |
| GM18075 | Cell line | HuVar | 130,655,292 | 3,060 | 96.1 | No | Yes |
| GM18084 | Cell line | HuVar | 127,693,612 | 2,991 | 97.0 | No | Yes |
| GM18087 | Cell line | HuVar | 116,883,425 | 2,738 | 95.3 | Yes | Yes |
| GM18089 | Cell line | HuVar | 113,522,775 | 2,659 | 93.8 | No | Yes |
| GM18090 | Cell line | HuVar | 139,175,351 | 3,260 | 95.6 | Yes | Yes |
| GM18091 | Cell line | HuVar | 140,749,311 | 3,297 | 96.1 | No | Yes |
| GM18507 | Cell line | HapMap | 116,001,927 | 2,717 | 99.2 | Yes | Yes |
| GM18524 | Cell line | HapMap | 123,974,593 | 2,904 | 99.4 | Yes | Yes |
| GM18526 | Cell line | HapMap | 68,506,615 | 1,605 | 98.2 | Yes | Yes |
| GM18529 | Cell line | HapMap | 103,011,729 | 2,413 | 99.2 | No | Yes |
| GM18532 | Cell line | HapMap | 93,010,560 | 2,178 | 98.9 | Yes | Yes |
| GM18537 | Cell line | HapMap | 88,541,054 | 2,074 | 98.2 | Yes | Yes |
| GM18540 | Cell line | HapMap | 107,018,419 | 2,507 | 99.3 | Yes | Yes |
| GM18558 | Cell line | HapMap | 110,404,280 | 2,586 | 99.3 | No | Yes |
| GM18561 | Cell line | HapMap | 94,941,108 | 2,224 | 98.7 | No | Yes |
| GM18562 | Cell line | HapMap | 109,707,907 | 2,570 | 99.4 | Yes | Yes |
| GM18563 | Cell line | HapMap | 132,909,807 | 3,113 | 95.9 | No | Yes |
| GM18668 | Cell line | Disease | 142,395,245 | 3,335 | 99.4 | Yes | Yes |
| GM18799 | Cell line | Disease | 117,599,230 | 2,754 | 99.2 | Yes | Yes |
| GM18800 | Cell line | Disease | 109,551,224 | 2,566 | 99.2 | Yes | Yes |
| GM18802 | Cell line | Disease | 87,204,605 | 2,042 | 98.8 | Yes | Yes |
| GM18886 | Cell line | Disease | 138,604,386 | 3,246 | 95.1 | Yes | Yes |
| GM18992 | Cell line | HapMap | 108,306,942 | 2,537 | 94.4 | Yes | Yes |

TABLE 6-continued

| Sample ID | Sample Source | Sample Type | Sequence (raw bp) | Average Coverage | Percentage of Bases >= 50X | Reproducibility? | Sanger Concordance? |
|---|---|---|---|---|---|---|---|
| GM18995 | Cell line | HapMap | 96,468,405 | 2,259 | 99.5 | No | Yes |
| GM18997 | Cell line | HapMap | 111,633,425 | 2,615 | 98.8 | No | Yes |
| GM18998 | Cell line | HapMap | 99,785,735 | 2,337 | 99.4 | Yes | Yes |
| GM18999 | Cell line | HapMap | 127,162,920 | 2,978 | 97.7 | No | Yes |
| GM19000 | Cell line | HapMap | 66,999,861 | 1,569 | 98.0 | Yes | Yes |
| GM19003 | Cell line | HapMap | 126,196,393 | 2,956 | 94.9 | No | Yes |
| GM19005 | Cell line | HapMap | 143,461,749 | 3,360 | 96.3 | No | Yes |
| GM19007 | Cell line | HapMap | 116,823,482 | 2,736 | 99.1 | No | Yes |
| GM19012 | Cell line | HapMap | 121,510,893 | 2,846 | 99.8 | Yes | Yes |
| GM19093 | Cell line | HapMap | 104,709,693 | 2,452 | 95.0 | Yes | Yes |
| GM19099 | Cell line | HapMap | 108,885,873 | 2,550 | 98.2 | Yes | Yes |
| GM19101 | Cell line | HapMap | 120,459,303 | 2,821 | 99.4 | Yes | Yes |
| GM19116 | Cell line | HapMap | 71,500,299 | 1,675 | 99.2 | No | Yes |
| GM19127 | Cell line | HapMap | 119,050,421 | 2,788 | 99.2 | Yes | Yes |
| GM19130 | Cell line | HapMap | 66,366,273 | 1,554 | 96.9 | No | Yes |
| GM19137 | Cell line | HapMap | 97,725,686 | 2,289 | 98.9 | Yes | Yes |
| GM19141 | Cell line | HapMap | 110,866,363 | 2,597 | 99.1 | Yes | Yes |
| GM19144 | Cell line | HapMap | 117,906,143 | 2,762 | 99.2 | No | Yes |
| GM19152 | Cell line | HapMap | 84,729,187 | 1,984 | 99.2 | Yes | Yes |
| GM19159 | Cell line | HapMap | 90,111,210 | 2,111 | 99.1 | Yes | Yes |
| GM19172 | Cell line | HapMap | 74,654,792 | 1,749 | 96.6 | No | Yes |
| GM19192 | Cell line | HapMap | 127,763,780 | 2,992 | 99.8 | Yes | Yes |
| GM19200 | Cell line | HapMap | 114,675,886 | 2,686 | 99.7 | Yes | Yes |
| GM19203 | Cell line | HapMap | 117,546,446 | 2,753 | 98.8 | Yes | Yes |
| GM19207 | Cell line | HapMap | 84,803,031 | 1,986 | 98.7 | Yes | Yes |
| GM19209 | Cell line | HapMap | 59,249,941 | 1,388 | 97.0 | Yes | Yes |
| GM19223 | Cell line | HapMap | 70,582,882 | 1,653 | 98.0 | Yes | Yes |
| GM19240 | Cell line | HapMap | 74,942,748 | 1,755 | 99.0 | Yes | Yes |
| GM19776 | Cell line | HapMap | 91,506,428 | 2,143 | 93.3 | No | Yes |
| GM19780 | Cell line | HapMap | 93,214,221 | 2,183 | 94.4 | No | Yes |
| GM19782 | Cell line | HapMap | 147,554,997 | 3,456 | 97.0 | No | Yes |
| GM19789 | Cell line | HapMap | 99,895,304 | 2,340 | 95.9 | Yes | Yes |
| GM19794 | Cell line | HapMap | 112,615,959 | 2,638 | 95.6 | Yes | Yes |
| GM20281 | Cell line | HapMap | 118,388,590 | 2,773 | 94.9 | Yes | Yes |
| GM20332 | Cell line | HapMap | 134,954,116 | 3,161 | 94.4 | Yes | Yes |
| GM20335 | Cell line | HapMap | 109,399,561 | 2,562 | 92.8 | Yes | Yes |
| GM20341 | Cell line | HapMap | 96,681,315 | 2,264 | 92.5 | Yes | Yes |
| GM20342 | Cell line | HapMap | 149,562,210 | 3,503 | 98.3 | Yes | Yes |

TABLE 6-continued

| Sample ID | Sample Source | Sample Type | Sequence (raw bp) | Average Coverage | Percentage of Bases >= 50X | Reproducibility? | Sanger Concordance? |
|---|---|---|---|---|---|---|---|
| GM20344 | Cell line | HapMap | 112,547,107 | 2,636 | 97.6 | Yes | Yes |
| GM20349 | Cell line | HapMap | 96,682,870 | 2,264 | 92.7 | No | Yes |
| GM20357 | Cell line | HapMap | 128,110,988 | 3,001 | 95.9 | No | Yes |
| GM20360 | Cell line | HapMap | 105,976,911 | 2,482 | 92.2 | No | Yes |
| GM20363 | Cell line | HapMap | 114,582,012 | 2,684 | 94.9 | No | Yes |
| GM20737 | Cell line | Disease | 86,947,571 | 2,036 | 98.4 | Yes | Yes |
| GM20741 | Cell line | Disease | 131,676,642 | 3,084 | 99.5 | Yes | Yes |
| GM20745 | Cell line | Disease | 120,425,678 | 2,821 | 99.4 | Yes | Yes |
| GM20845 | Cell line | HapMap | 88,592,183 | 2,075 | 98.5 | No | Yes |
| GM20846 | Cell line | HapMap | 94,474,722 | 2,213 | 98.9 | No | Yes |
| GM20847 | Cell line | HapMap | 132,183,920 | 3,096 | 94.6 | No | Yes |
| GM20849 | Cell line | HapMap | 94,859,450 | 2,222 | 99.2 | Yes | Yes |
| GM20850 | Cell line | HapMap | 89,746,969 | 2,102 | 98.9 | Yes | Yes |
| GM20851 | Cell line | HapMap | 105,058,248 | 2,461 | 98.9 | No | Yes |
| GM20852 | Cell line | HapMap | 103,469,223 | 2,423 | 99.2 | Yes | Yes |
| GM20853 | Cell line | HapMap | 67,451,488 | 1,580 | 99.0 | Yes | Yes |
| GM20854 | Cell line | HapMap | 125,360,575 | 2,936 | 95.9 | No | Yes |
| GM20856 | Cell line | HapMap | 125,206,711 | 2,933 | 95.1 | Yes | Yes |
| GM20858 | Cell line | HapMap | 102,707,143 | 2,406 | 99.3 | Yes | Yes |
| GM20859 | Cell line | HapMap | 107,012,009 | 2,506 | 98.9 | No | Yes |
| GM20861 | Cell line | HapMap | 146,690,573 | 3,436 | 96.3 | No | Yes |
| GM20862 | Cell line | HapMap | 121,310,107 | 2,841 | 99.4 | Yes | Yes |
| GM20866 | Cell line | HapMap | 106,527,164 | 2,495 | 99.4 | Yes | Yes |
| GM20869 | Cell line | HapMap | 88,099,219 | 2,063 | 99.4 | Yes | Yes |
| GM20870 | Cell line | HapMap | 84,570,991 | 1,981 | 99.0 | Yes | Yes |
| GM20871 | Cell line | HapMap | 104,048,645 | 2,437 | 98.9 | No | Yes |
| GM20872 | Cell line | HapMap | 90,867,460 | 2,128 | 99.0 | No | Yes |
| GM20873 | Cell line | HapMap | 108,700,925 | 2,546 | 99.3 | No | Yes |
| GM20924 | Cell line | Disease | 120,376,414 | 2,819 | 99.2 | Yes | Yes |
| GM21080 | Cell line | Disease | 66,554,012 | 1,559 | 97.3 | Yes | Yes |
| blood01 | Blood | N/A | 67,892,054 | 1,594 | 99.9 | No | No |
| blood02 | Blood | N/A | 75,235,946 | 1,766 | 99.9 | No | No |
| blood03 | Blood | N/A | 71,324,606 | 1,674 | 99.9 | No | No |
| blood04 | Blood | N/A | 58,883,762 | 1,382 | 99.9 | No | No |
| blood05 | Blood | N/A | 74,862,133 | 1,757 | 99.9 | No | No |
| blood06 | Blood | N/A | 77,267,380 | 1,814 | 99.9 | No | No |
| blood07 | Blood | N/A | 55,719,056 | 1,308 | 99.9 | No | No |
| blood08 | Blood | N/A | 64,495,882 | 1,514 | 99.9 | No | No |
| blood09 | Blood | N/A | 67,663,353 | 1,588 | 99.9 | No | No |
| blood10 | Blood | N/A | 57,362,443 | 1,347 | 99.9 | No | No |
| blood11 | Blood | N/A | 53,823,416 | 1,264 | 99.9 | No | No |
| blood12 | Blood | N/A | 73,097,398 | 1,716 | 99.9 | No | No |
| blood13 | Blood | N/A | 73,858,165 | 1,734 | 99.9 | No | No |
| blood14 | Blood | N/A | 87,675,439 | 2,058 | 99.9 | No | No |
| blood15 | Blood | N/A | 74,484,474 | 1,749 | 99.8 | No | No |
| blood16 | Blood | N/A | 59,096,764 | 1,387 | 99.8 | No | No |

TABLE 6-continued

| Sample ID | Sample Source | Sample Type | Sequence (raw bp) | Average Coverage | Percentage of Bases >= 50X | Reproducibility? | Sanger Concordance? |
|---|---|---|---|---|---|---|---|
| blood17 | Blood | N/A | 65,114,672 | 1,529 | 99.9 | No | No |
| blood18 | Blood | N/A | 41,759,247 | 980 | 99.9 | No | No |
| blood19 | Blood | N/A | 71,949,103 | 1,689 | 99.9 | No | No |
| blood20 | Blood | N/A | 81,225,381 | 1,907 | 99.9 | No | No |
| blood21 | Blood | N/A | 70,214,097 | 1,648 | 99.9 | No | No |
| blood22 | Blood | N/A | 72,674,504 | 1,706 | 99.9 | No | No |
| blood23 | Blood | N/A | 74,340,749 | 1,745 | 99.9 | No | No |
| blood24 | Blood | N/A | 64,015,737 | 1,503 | 99.9 | No | No |
| blood25 | Blood | N/A | 73,147,784 | 1,717 | 99.8 | No | No |
| blood26 | Blood | N/A | 41,950,444 | 985 | 99.8 | No | No |
| blood27 | Blood | N/A | 62,771,860 | 1,474 | 99.8 | No | No |
| blood28 | Blood | N/A | 47,085,570 | 1,105 | 99.8 | No | No |
| blood29 | Blood | N/A | 74,840,986 | 1,757 | 99.9 | No | No |
| blood30 | Blood | N/A | 73,612,767 | 1,728 | 99.9 | No | No |
| blood31 | Blood | N/A | 70,446,967 | 1,654 | 99.9 | No | No |
| blood32 | Blood | N/A | 86,513,773 | 2,031 | 99.9 | No | No |
| blood33 | Blood | N/A | 78,330,087 | 1,839 | 99.9 | No | No |
| blood34 | Blood | N/A | 76,890,117 | 1,805 | 99.9 | No | No |
| blood35 | Blood | N/A | 63,472,751 | 1,490 | 99.9 | No | No |
| blood36 | Blood | N/A | 77,259,799 | 1,814 | 99.9 | No | No |
| blood37 | Blood | N/A | 74,384,590 | 1,746 | 99.9 | No | No |
| blood38 | Blood | N/A | 87,075,653 | 2,044 | 99.9 | No | No |
| blood39 | Blood | N/A | 61,490,312 | 1,444 | 99.9 | No | No |
| blood40 | Blood | N/A | 83,490,415 | 1,960 | 99.9 | No | No |
| blood41 | Blood | N/A | 94,474,694 | 2,218 | 99.9 | No | No |
| blood42 | Blood | N/A | 79,180,999 | 1,859 | 99.9 | No | No |
| blood43 | Blood | N/A | 70,106,334 | 1,646 | 99.9 | No | No |
| blood44 | Blood | N/A | 66,239,225 | 1,555 | 99.9 | No | No |
| blood45 | Blood | N/A | 76,565,215 | 1,797 | 99.8 | No | No |
| blood46 | Blood | N/A | 66,932,062 | 1,571 | 99.9 | No | No |
| blood47 | Blood | N/A | 37,972,652 | 891 | 99.8 | No | No |
| blood48 | Blood | N/A | 66,880,850 | 1,570 | 99.9 | No | No |
| blood49 | Blood | N/A | 65,267,319 | 1,532 | 99.9 | No | No |
| blood50 | Blood | N/A | 63,720,579 | 1,496 | 99.9 | No | No |
| blood51 | Blood | N/A | 64,485,398 | 1,514 | 99.9 | No | No |
| blood52 | Blood | N/A | 90,657,228 | 2,128 | 99.9 | No | No |
| blood53 | Blood | N/A | 83,058,297 | 1,950 | 99.9 | No | No |
| blood54 | Blood | N/A | 86,145,665 | 2,022 | 99.9 | No | No |
| blood55 | Blood | N/A | 77,159,945 | 1,811 | 99.9 | No | No |
| blood56 | Blood | N/A | 88,169,014 | 2,070 | 99.9 | No | No |
| blood57 | Blood | N/A | 60,859,847 | 1,429 | 99.9 | No | No |
| blood58 | Blood | N/A | 72,504,883 | 1,702 | 99.9 | No | No |
| blood59 | Blood | N/A | 83,924,327 | 1,970 | 99.9 | No | No |

The DNA extraction protocol used for our blood samples concluded with an overnight incubation at 65° C. in a Tris-based buffer. Subsequent experiments showed that this step reduced the mean size of the purified DNA; shearing was likely caused by acid hydrolysis during a temperature-induced pH shift of the buffer. Lower molecular mass genomic DNA is more readily denatured, and therefore more accessible to molecular inversion probes, which improves capture reaction performance. Consistent with this hypothesis, overnight incubation temperature lowered to 25° C. significantly reduces the percentage of target bases that yield high confidence genotype calls.

To assess reproducibility, a subset of 126 samples derived from cell line DNA (Appendix A) was processed twice, each time by a different operator on different liquid handling equipment. At least 92% of bases were called at >=50x coverage in all samples, with high agreement between replicates (Pearson correlation coefficient 0.868). Out of 5,177,206 total genotype calls compared, 17 were discordant, for a concordance rate of 0.999997. These occurred at only 5 unique genomic positions, consistent with systematic sequencing error as the primary cause.

Sanger Concordance

Figure 15A:
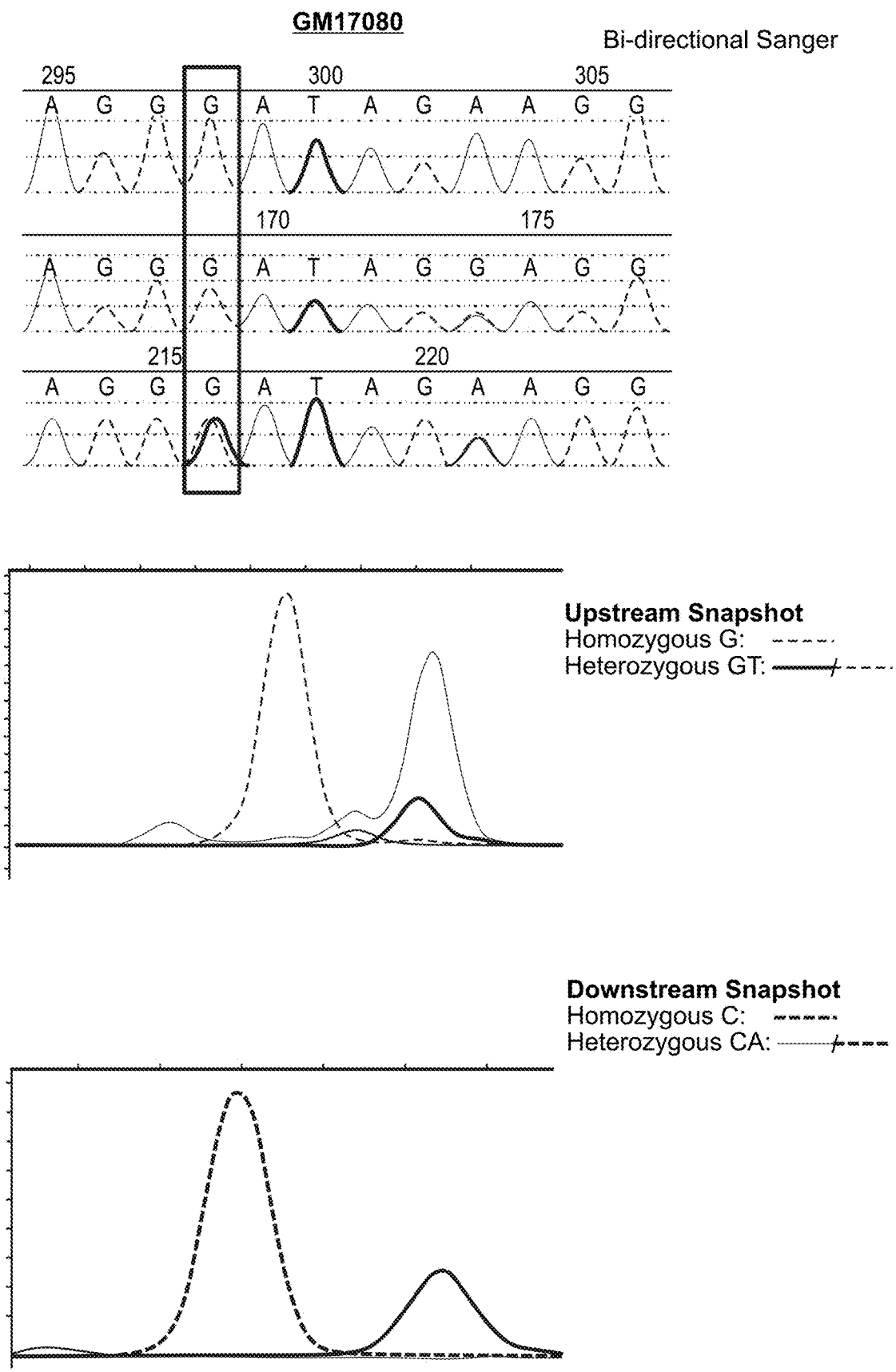
FIGS. 15A-B show a SNaPshot validation of a putative Sanger variant call.
Figure 15B:
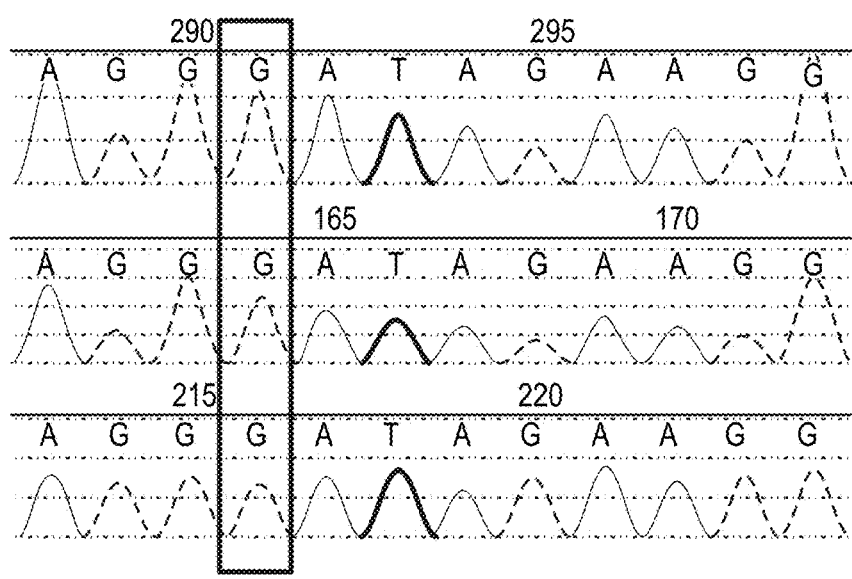
Figure 15B:
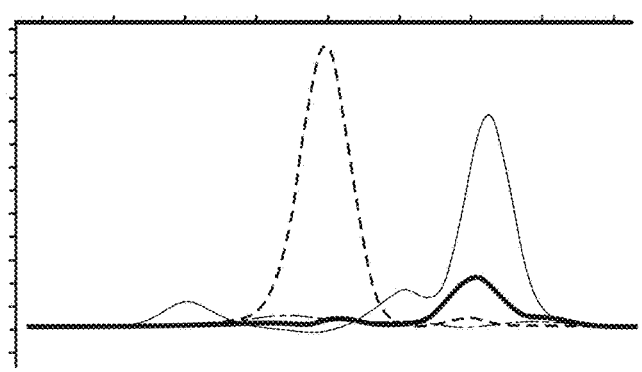
Figure 15B:
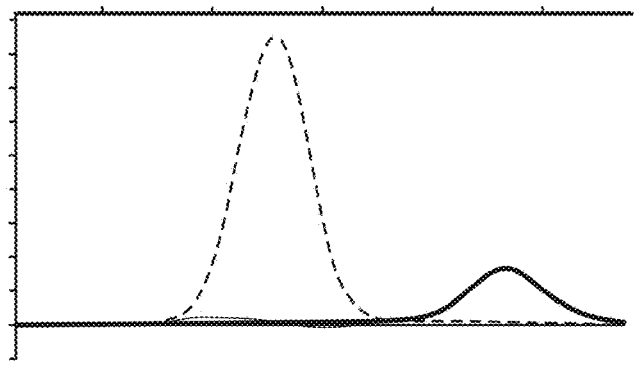

To assess the overall accuracy of our NGS genotype calls, the genotype calls from the NGS pipeline were compared to those generated by automated analysis (Mutation Surveyor, MS) of bi-directional Sanger sequence of PCR amplicons in a subset of 194 samples. Within a total of 6,997,906 bp of sequence called by both methods, 3,973 concordant and 1,220 discordant single nucleotide variant (SNV) genotype calls were observed. Through manual inspection of the Sanger trace(s) corresponding to discordant genotype calls, it was determined that 1,139 were MS errors, generally caused by low quality traces or misalignment of traces to reference. Supporting the conclusion that the majority of discordant calls corresponded to incorrect Sanger calls, the Ti/Tv ratio of concordant genotype calls was observed as 3.19, and 0.61 for discordant Sanger calls eliminated as MS errors. The remaining 81 discordant genotype calls that could not be resolved because the corresponding traces were ambiguous, were re-amplified and re-sequenced. For 71 of these calls, this process yielded new Sanger data that led to the conclusion that the original automated Sanger calls were incorrect. An additional discordant call was resolved by another approach as a NGS true negative (FIGS. 15A-B), leaving 9 high-confidence discordant SNV calls (Table 7), corresponding to 8 NGS false positives and 1 NGS false negative. Table 7 shows a comparison of NGS genotype calls (alignment-only algorithm) to Sanger-derived Mutation Surveyor genotype calls. Sanger genotype calls were considered truth. TP, true positive calls (non-reference NGS, non-reference Sanger); FP, false positive calls (non-reference NGS, reference Sanger); FN, false negative calls (reference NGS, non-reference Sanger); TN, true negative calls (reference NGS, reference Sanger). dbSNP membership determined relative to version 129. Indel calls were considered unique if they differed by sequence pattern or equivalence region. Known indels are disease-causing mutations present in previously-annotated samples.

TABLE 7

| | | | TP | FP | FN | TN |
|---|---|---|---|---|---|---|
| SNV | Heterozygous | dbSNP | 2,495 | 0 | 1 | 6,992,746 |
| | | not dbSNP | 247 | 8 | 0 | |
| | Homozygous | dbSNP | 1,245 | 0 | 0 | |
| | | not dbSNP | 13 | 0 | 0 | |
| | Unique | | 231 | 3 | 1 | |
| Indel | Total | | 61 | 396 | 3 | 6,992,358 |
| | Unique | | 17 | 27 | 2 | |
| | Known | | 31 | — | 0 | |

The NGS SNV false positive rate was 1.14×10-6 (95% Wilson binomial confidence interval [5.80×10-7 2.26×10-6]). The false positive calls occurred at 5 unique genomic loci, 3 of which were at adjacent positions in a single exon of gene MCOLN1 due to realignment within GATK.

Figure 16A:
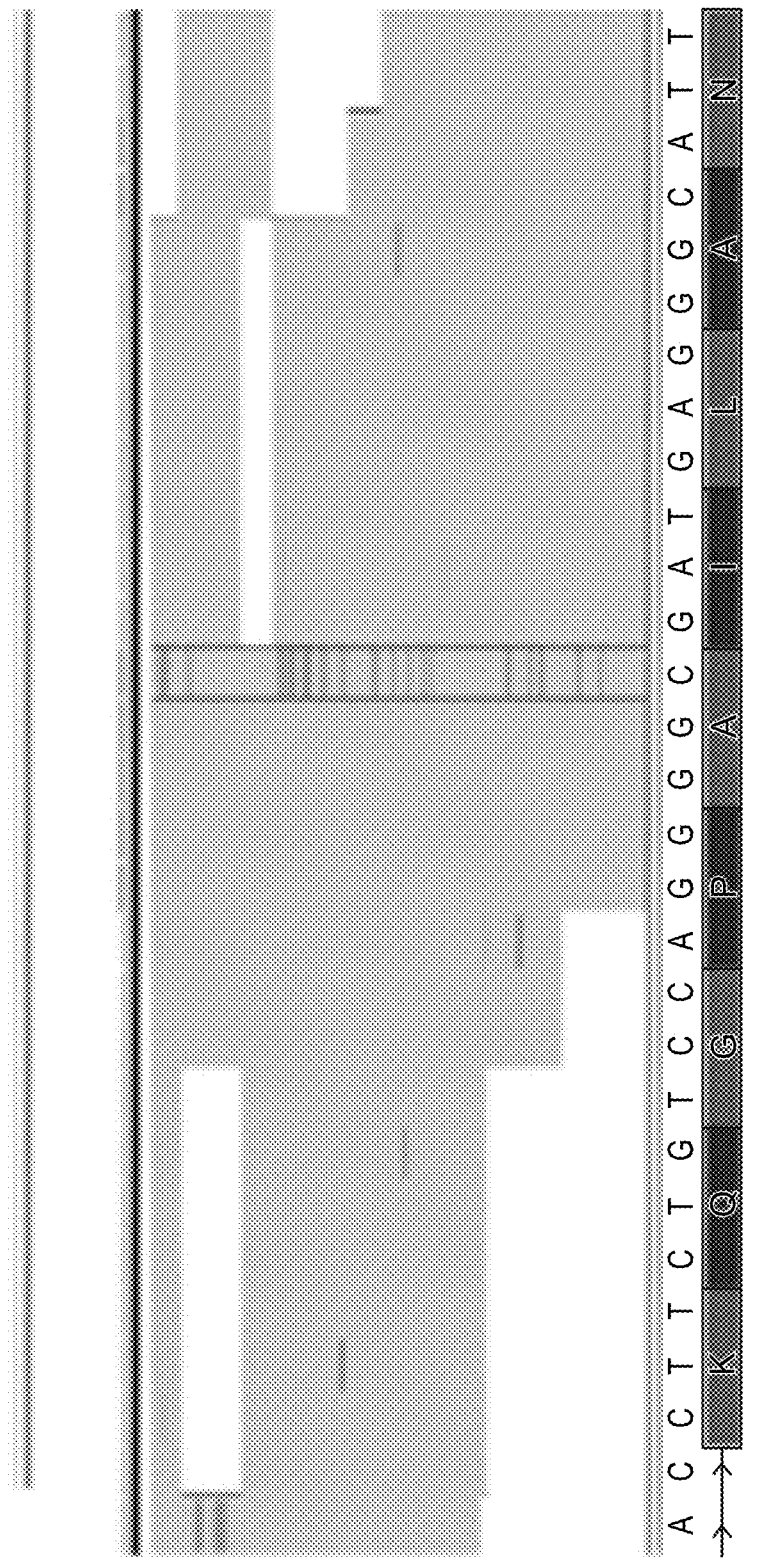
FIGS. 16A-16D depict skewed allelic fractions in aneuploid cell line GM18540.
Figure 16B:
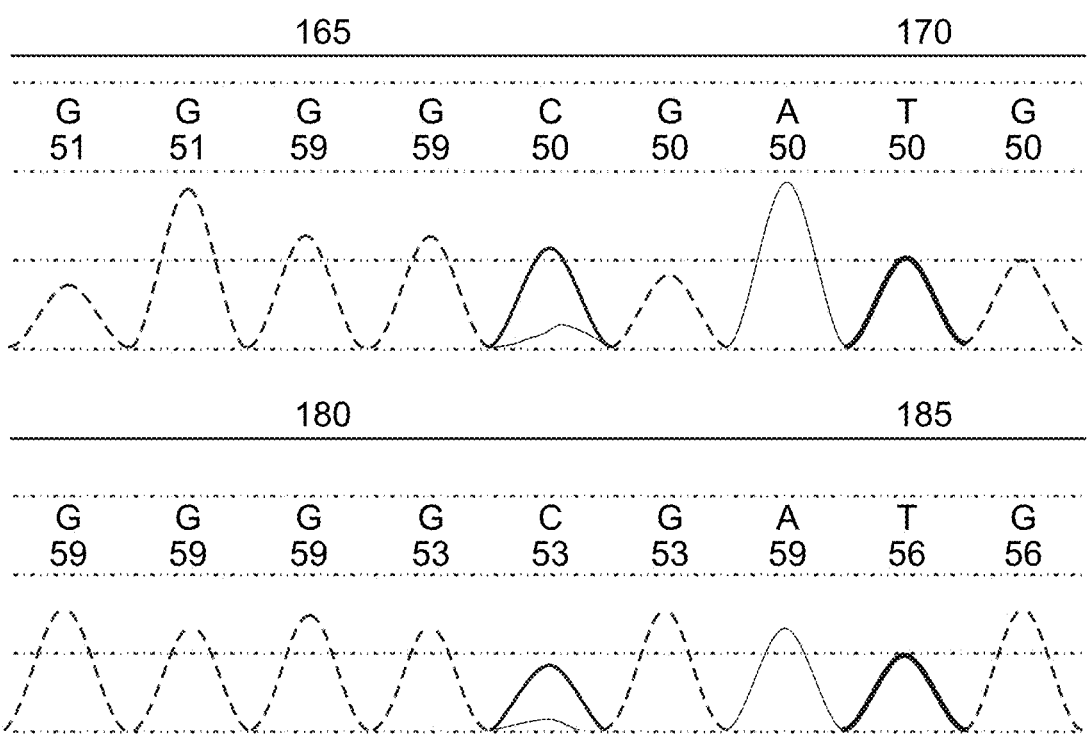
Figure 16C:
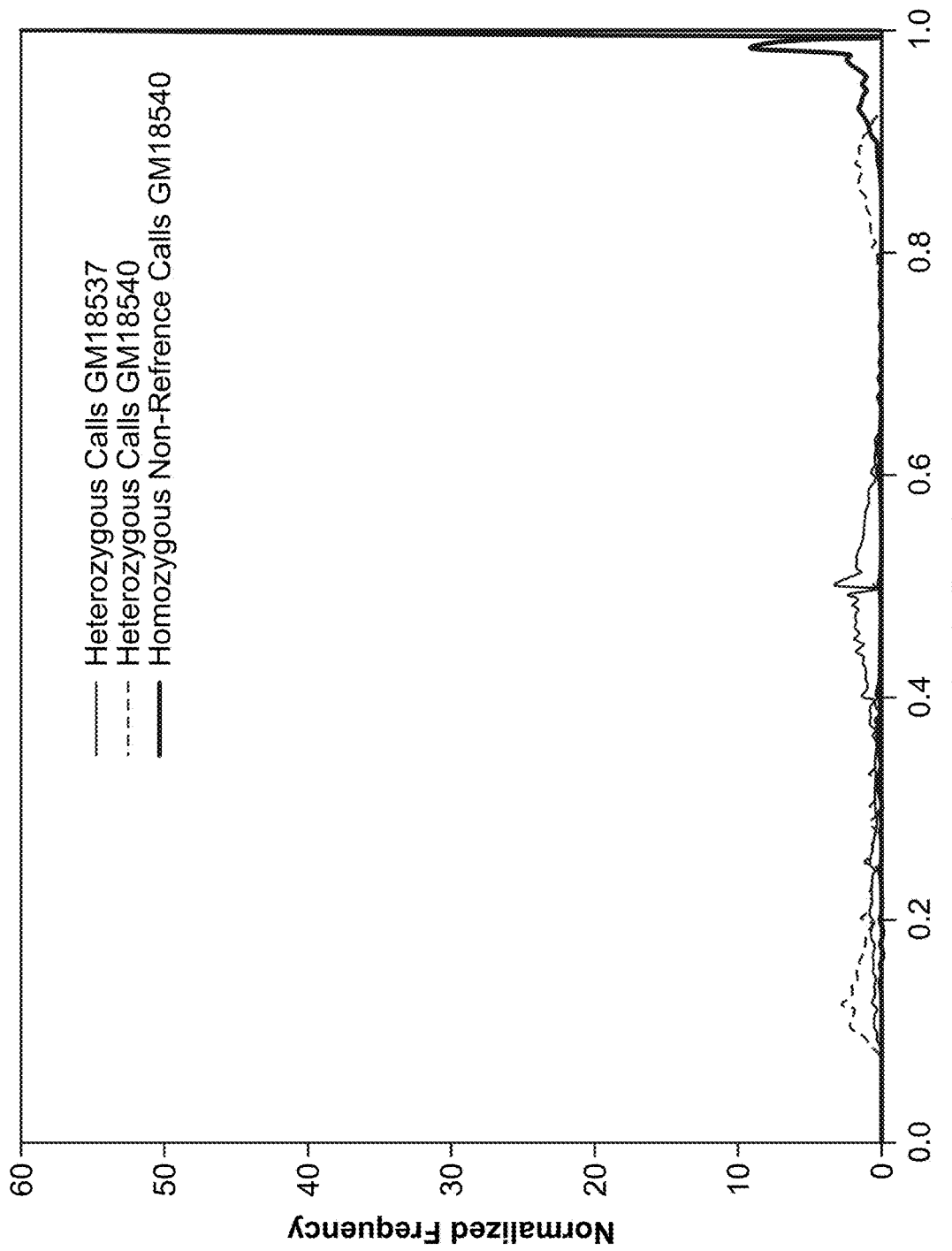
Figure 16D:
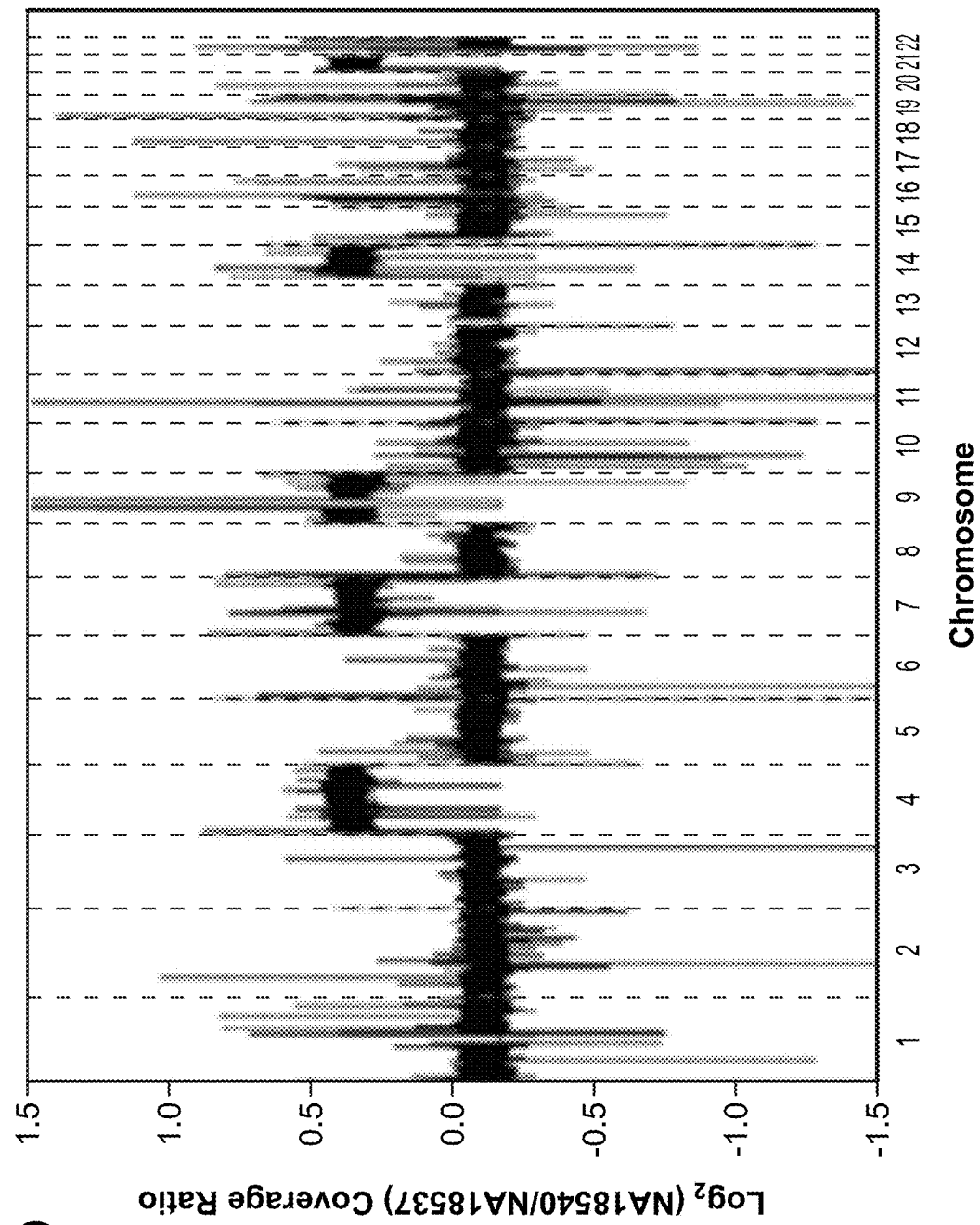
Figure 17A:
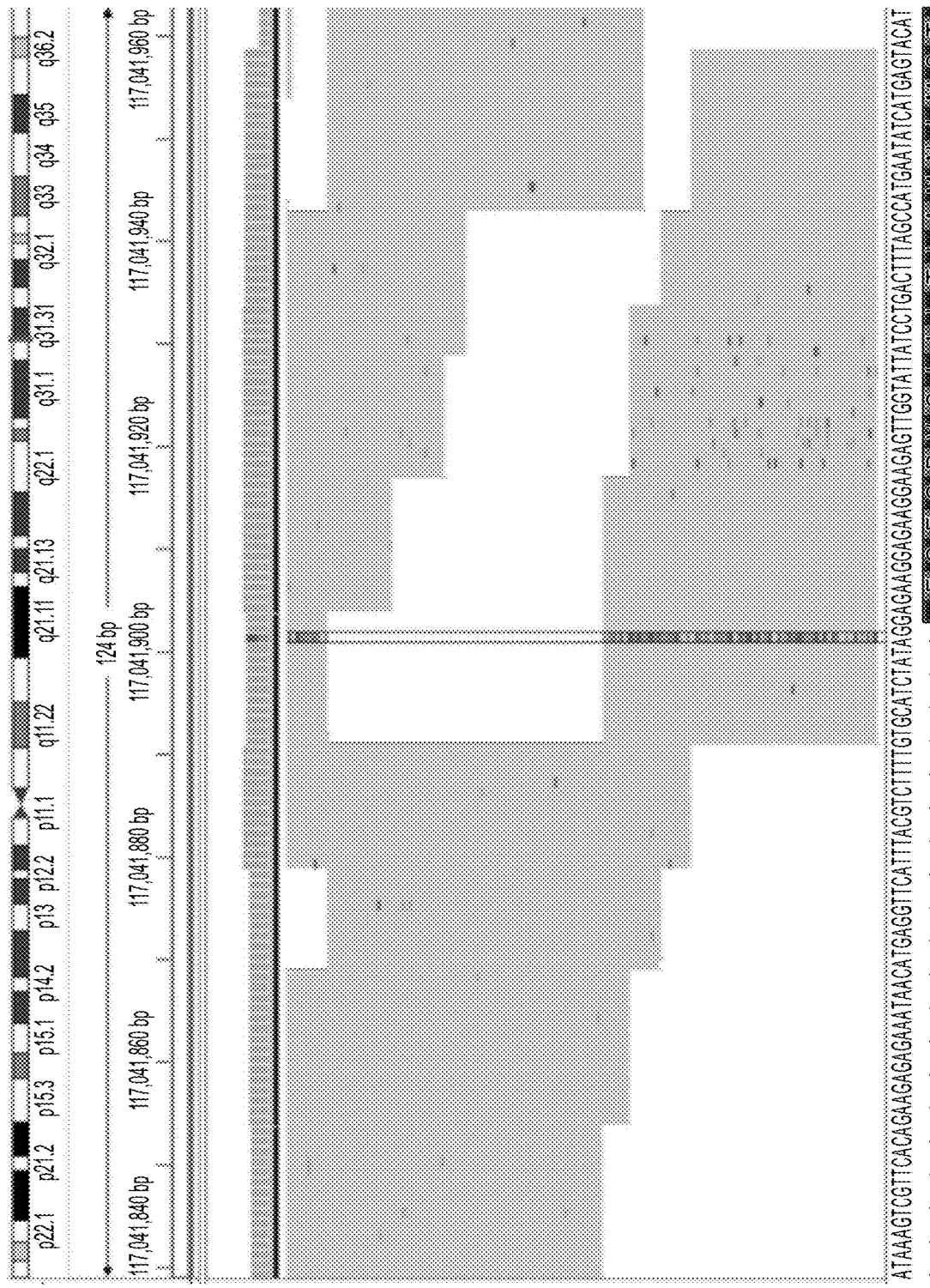
FIGS. 17A-D depict detection of previously-uncharacterized mutations in samples from individuals affected with cystic fibrosis.
Figure 17B:
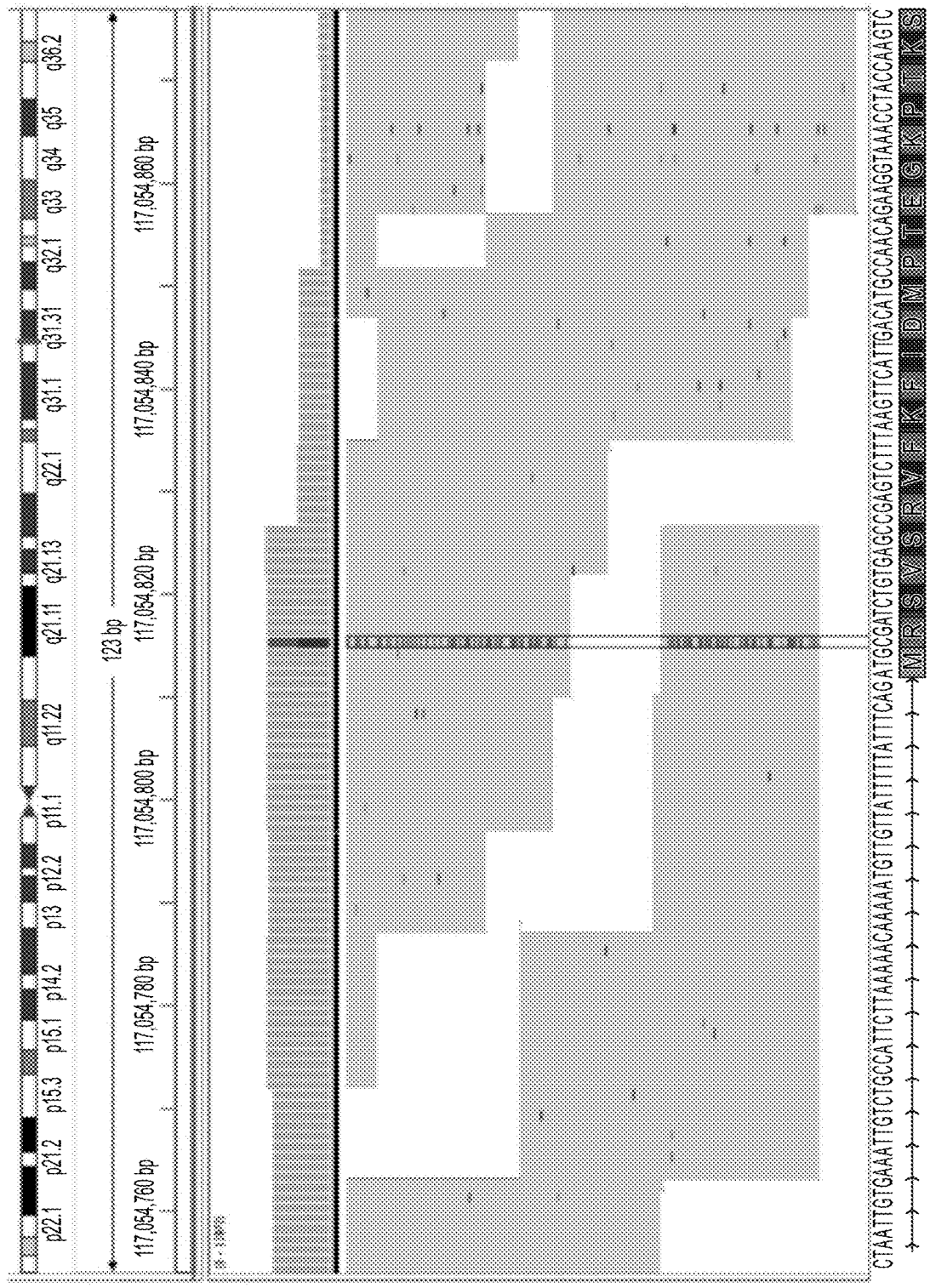
Figure 17C:
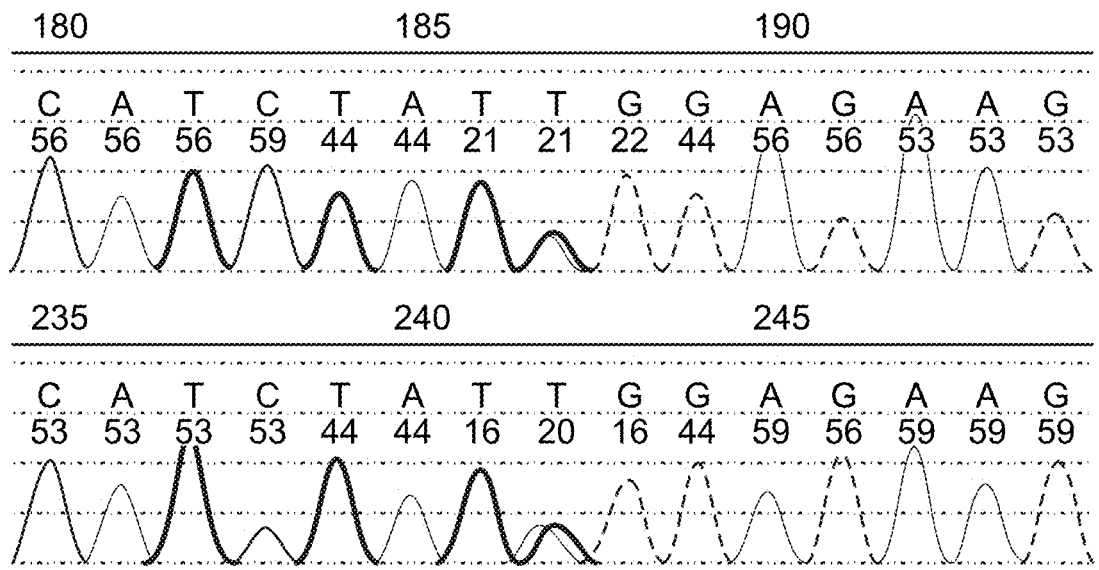
Figure 17D:
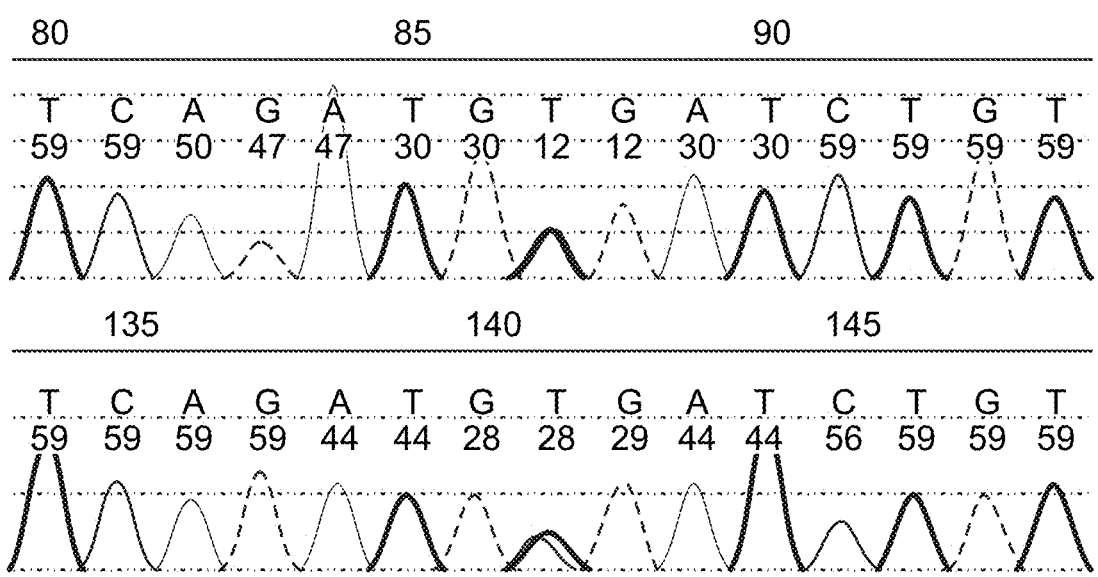

FIG. 16A-D shows GM18540 is an aneuploid cell line and hence yields skewed allelic fractions. FIG. 16A gives an IGV view of NGS data from GM18540 for the genotype call of interest (shown between vertical lines). FIG. 16B shows bi-directional Sanger data for the variant-containing region. FIG. 16C provides a histogram of allele ratios for all non-reference genotype calls in chromosome 11 derived from whole-genome shotgun sequencing (WGSS) of GM18540 and control sample GM18537. FIG. 16D shows genome-wide relative coverage for GM18540. WGSS coverage data for each of the autosomes was binned into 50 Kb intervals and the log-ratio of the per-sample mean normalized values was plotted versus chromosome position. Dashed vertical lines denote chromosome boundaries; within a chromosome the ratios are arranged according to genomic position.

The NGS SNV false negative rate was 2.50×10-4 (95% Wilson binomial confidence interval [1.28×10-5 1.41×10-3]). The false negative call observed occurred in chromosome 11 of a sample previously characterized as aneuploid. Out of 473 NGS reads covering the false negative locus, 9.5% supported the correct heterozygous A/C genotype call (FIG. 16A), with Sanger sequencing showing low peak height for the alternate A allele (FIG. 16B). Shotgun full-genome sequencing of this sample demonstrated a bimodal distribution of allele ratios for heterozygous calls in chromosome 11 (FIG. 16C), and illustrated variable chromosome copy numbers (FIG. 16D), supporting the conclusion that this sample was aneuploid.

For indels, a total of 61 true positives, 394 false positives (27 unique alleles) and 3 false negatives (2 unique alleles, both in exon 1 of SMPD1) were observed. Of 31 clinically-relevant disease mutations, all 31 were detected.

iii. Detection of Pathogenic Mutations

The ability to detect variants that cause the Mendelian diseases targeted by the panel (Table 5) in the set of 194 cell line-derived samples was assessed. 55 of these samples were derived from individuals who were either carriers of or affected by one of the diseases being assayed and collectively contained a total of 95 previously-characterized disease mutations. During the design of our NGS workflow, we determined that three of these lesions would be inaccessible by our approach—two were large deletions spanning multiple exons, and one was contained within a region of paralogous sequence in the tenth exon of CFTR (Table 8). Of the 92 mutations we could expect to detect by NGS, we detected all 92 (Table 8). We also identified truncating (and likely disease-causing) mutations in two affected samples where previously only one mutation was known (FIGS. 17A-D, Table 8), as well as 9 carriers in the set of 139 previously-uncharacterized HapMap, Thousand Genomes Project, and Human Diversity Panel samples (Table 8).

Table 8 shows pathogenic mutations detected in cell line-derived samples. Mutations underlined were determined a priori to be inaccessible by NGS and therefore not evaluated here. Mutations listed with an asterisk represent mutations in affected individuals that were previously unknown. Mutations listed in square brackets were present in Hapmap samples previously unannotated with respect to carrier status.

TABLE 8

| Sample | Gene | Mut1 Common Name | Mut1 Found? | Mut2 Common Name | |
|---|---|---|---|---|---|
| GM04268 | ASPA | E285A | Yes | E285A | Yes |
| GM00649 | BCKDHA | Y438N | Yes | 8 bp del exon 7 | Yes |
| GM00650 | BCKDHA | Y438N | Yes | — | Yes |
| GM01531 | CFTR | PHE508DEL | Yes | PHE508DEL | Yes |
| GM02828 | CFTR | V520F | Yes | PHE508DEL | Yes |
| GM04330 | CFTR | 1812 – IG > A | Yes | 444delA | Yes |
| GM06966 | CFTR | E92X | Yes | PHE508DEL | Yes |
| GM07381 | CFTR | IVS19DS, +10 KB, C > T (3849 + 10 kb C > T) | Yes | PHE508DEL | Yes |
| GM07441 | CFTR | 621 + 1G > T | Yes | IVS16, G > A, +1(3120 + 1G > A) | Yes |
| GM07552 | CFTR | ARG553TER | Yes | PHE508DEL | Yes |
| GM07732 | CFTR | E60X | Yes | PHE508DEL | Yes |
| GM07857 | CFTR | M11O1K | Yes | M11O1K | Yes |
| GM08338 | CFTR | GLY551ASP | Yes | — | Yes |
| GM11275 | CFTR | 1-BP DEL, 3659C | Yes | PHE508DEL | Yes |
| GM11277 | CFTR | ILE507DEL | Yes | ILE507DEL | Yes |
| GM11278 | CFTR | Q493X | Yes | PHE508DEL | Yes |
| GM11280 | CFTR | 621 + 1G > T | Yes | 711 + 1G > T | Yes |
| GM11281 | CFTR | 621 + 1G > T | Yes | PHE508DEL | Yes |
| GM11282 | CFTR | 621 + 1G > T | Yes | GLY85GLU | Yes |
| GM11283 | CFTR | ALA455GLU | N/A | PHE508DEL | Yes |
| GM11284 | CFTR | ARG560THR | Yes | PHE508DEL | Yes |
| GM11285 | CFTR | Y1092X | Yes | PHE508DEL | Yes |
| GM11287 | CFTR | P574H | Yes | PHE508DEL | Yes |
| GM11288 | CFTR | G178R | Yes | PHE508DEL | Yes |
| GM11370 | CFTR | 444delA | Yes | 1VS11 – 1G > A | Yes |
| GM11472 | CFTR | ASN1303LYS | Yes | GLY1349ASP | Yes |
| GM11496 | CFTR | GLY542TER | Yes | GLY542TER | Yes |
| GM11497 | CFTR | GLY542TER | Yes | — | — |
| GM11723 | CFTR | TRP1282TER | Yes | — | — |
| GM11859 | CFTR | 2789 + 5G > A | Yes | 2789 + 5G > A | Yes |
| G M11860 | CFTR | IVS19DS, +10 KB, C > T(3849 + 10 kb C > T) | Yes | IVS19DS, +10 KB, C > T(3849 + 10 kb C > T) | Yes |
| G M12444 | CFTR | IVS10AS, G > A, -1 (1717 – IG > A) | Yes | — | — |
| G M12585 | CFTR | ARG1162TER | Yes | — | — |
| G M12785 | CFTR | ARG347PRO | Yes | GLY551ASP | Yes |
| GM12960 | CFTR | ARG334TRP | Yes | c.3368 – 2A > T* | Yes |

TABLE 8-continued

| Sample | Gene | Mut1 Common Name | Mut1 Found? | Mut2 Common Name | |
|---|---|---|---|---|---|
| GM13423 | CFTR | G85E | Yes | D1152H | Yes |
| G M13591 | CFTR | ARG117HIS | Yes | PHE508DEL | Yes |
| GM18668 | CFTR | CFTdele2, 3 | N/A | PHE508DEL | Yes |
| GM18799 | CFTR | 2183delA | | PHE508DEL | Yes |
| GM18800 | CFTR | 1898 + 1 G > A | | PHE508DEL | Yes |
| GM18802 | CFTR | Y122X | | R1158X* | Yes |
| GM18886 | CFTR | 2143delT | | PHE508DEL | Yes |
| GM20737 | CFTR | R347H | | — | — |
| GM20741 | CFTR | 3876delA | | — | — |
| GM20745 | CFTR | S549N | | — | — |
| GM20924 | CFTR | R75X | | — | — |
| GM21080 | CFTR | 349delTT | | — | — |
| GM11468 | G6PC | R83C | | Q347X | Yes |
| GM00502 | HEXA | 1278insTATC | | 1421 + 1G > C | Yes |
| GM03461 | HEXA | 1421 + 1G > C | | G269S | Yes |
| GM05042 | IKBKAP | 2507 + 6T > C | | 2507 + 6T > C | Yes |
| GM02533 | MCOLN1 | IVS3 – 2A > G | Yes | del ex1-ex7 | N/A |
| GM03252 | SMPD1 | L302P | | — | — |
| GM13205 | SMPD1 | fsP330 | | — | — |
| G M16193 | SMPD1 | R496L | | Arg608DEL | Yes |
| G M19116 | CFTR | [ARG334TRP] | Yes | — | — |
| G M17363 | IKBKAP | [2507 + 6T > C] | Yes | — | — |
| G M17366 | IKBKAP | [2507 + 6T > C] | Yes | — | — |
| GM17365 | IKBKAP | [2507 + 6T > C] | Yes | — | — |
| GM17364 | IKBKAP | [2507 + 6T > C] | Yes | — | — |
| GM17360 | MCOLN1 | [IVS3 – 2A > G] | Yes | — | — |
| GM17362 | HEXA | [1278insTATC] | Yes | — | — |
| GM18015 | HEXA | [c.739C > T] | Yes | — | — |
| GM17362 | HEXA | [G269S] | Yes | — | — |

Genotyping by Assembly—Templated Alignment

Although substitutions comprise the majority of coding variation in the human genome, insertions and deletions (indels) are often clinically relevant. Indels, especially when large or present in cis with substitutions, are notoriously difficult to detect with short NGS reads. Assembly of short reads can improve indel detection sensitivity, but this is often at the cost of decreased SNV and indel specificity due to the presence of spurious contiguous sequence (contigs). An algorithm was devised termed Genotyping by Assembly-Templated Alignment (GATA), that first forms an assembly from reads partitioned into subsets by targeting arm sequence, then performs base quality- and coverage-informed genotyping by alignment of raw reads back to the assembled contigs (FIGS. 18A-18E).

Figure 18A:
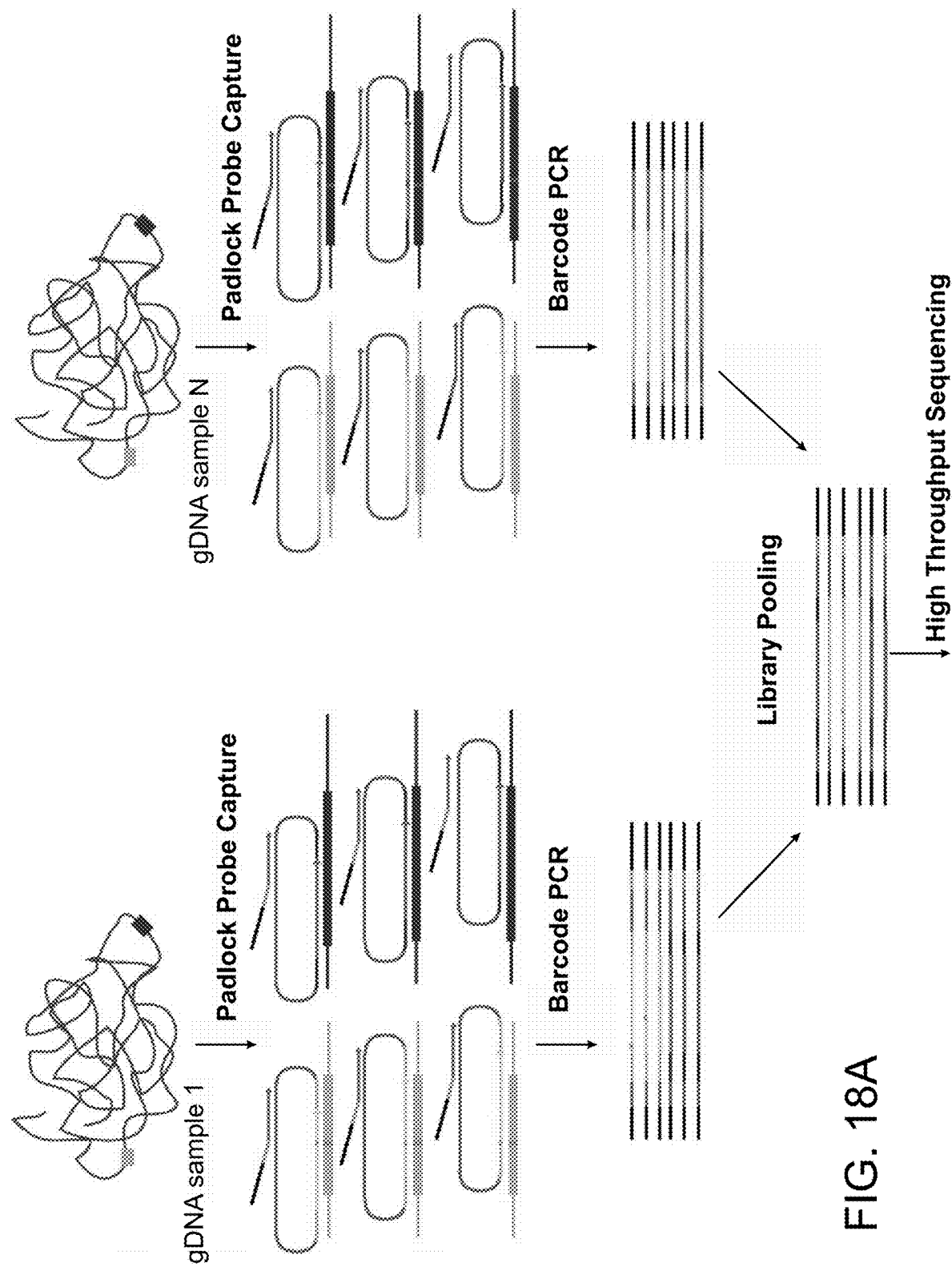
Figure 18D:
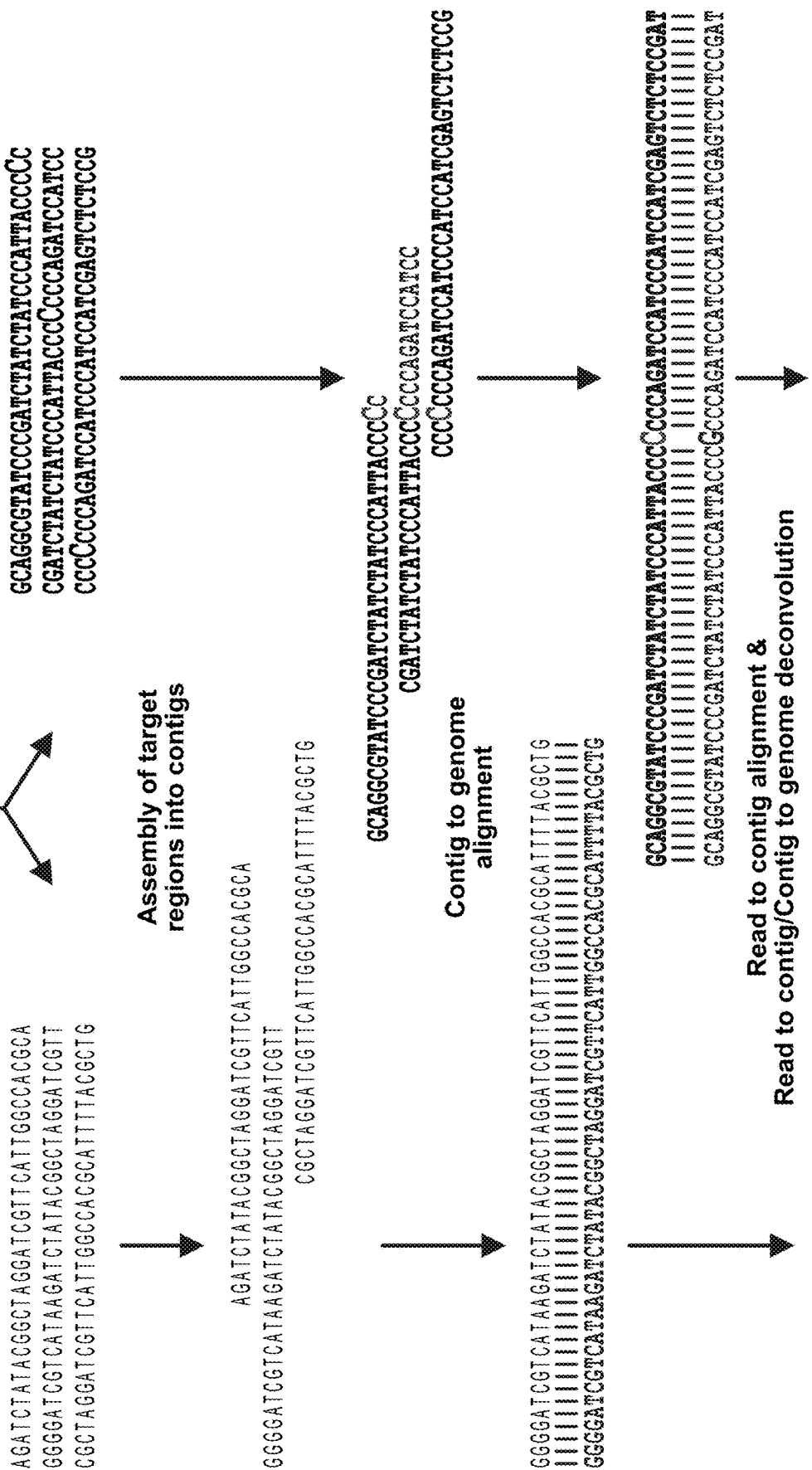
Figure 18E:
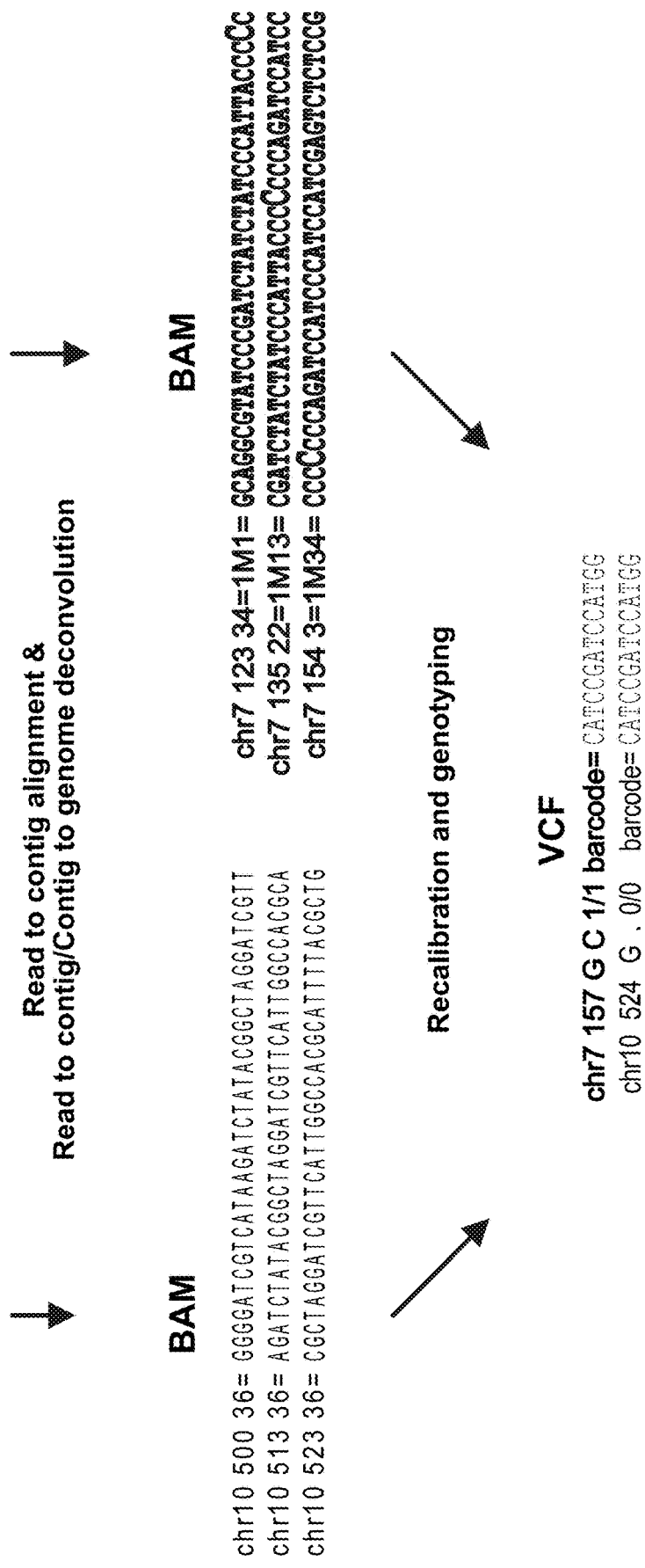
Figure 19A:
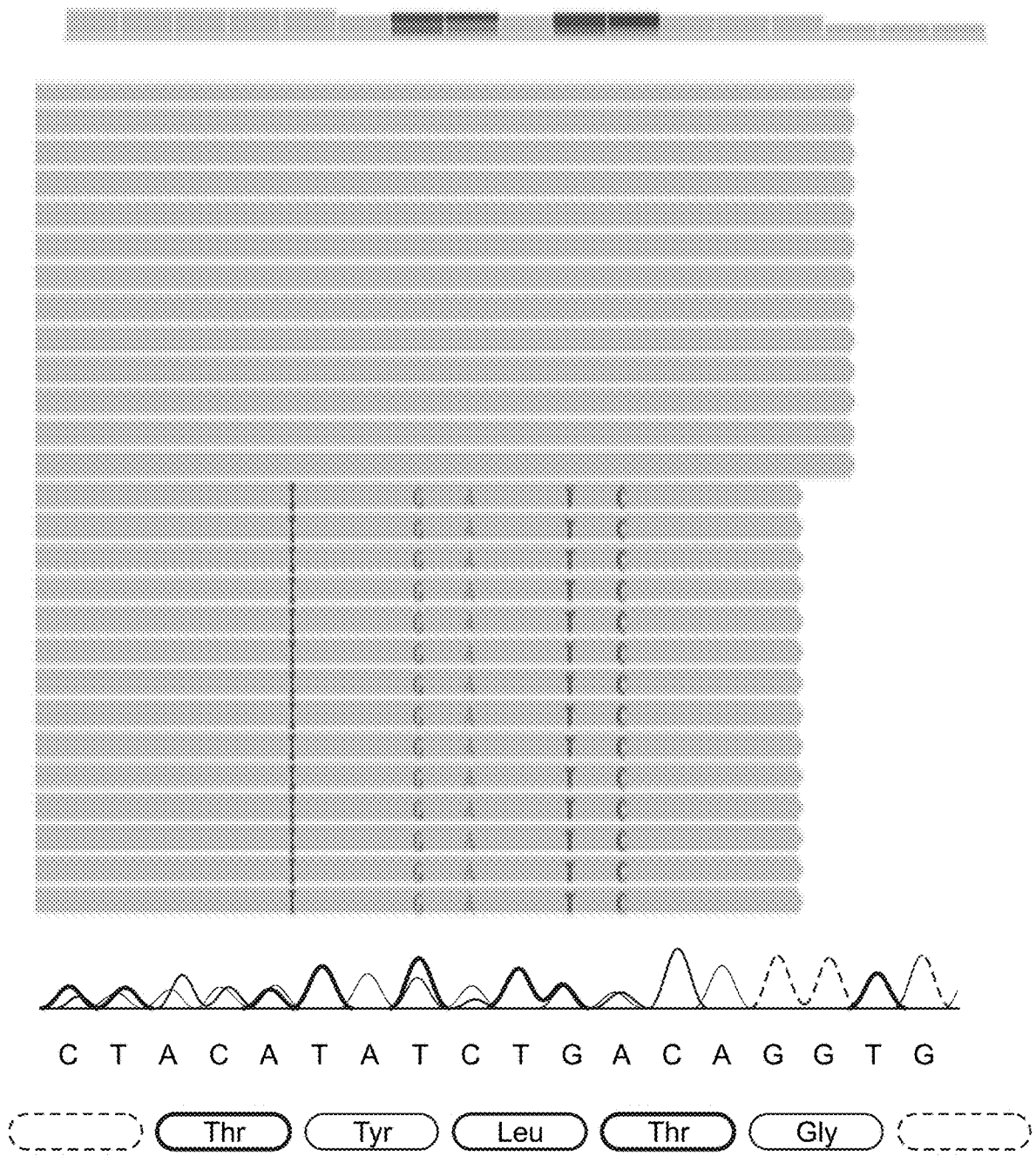
FIGS. 19A-D depict data from genotyping by assembly template alignment (GATA). GATA correctly genotypes insertions and deletions that are undetectable by the Alignment Only method. Read from top to bottom, each panel provides tracks for cumulative depth of coverage (vertical grey bars); representative MIP alignments (horizontal grey bars) with mismatches (letters), insertions (black bars), and gaps (dashed lines); chromatogram; reference DNA and amino acid sequence for FIG. 19A heterozygous BLM c.2207_2212delinsTAGATTC in sample GM04408 as well as several alleles in the first exon of SMPD1 (FIG. 19A discloses SEQ ID NO: 6365 and 6366) including FIG. 19B a heterozygous 18 bp deletion in sample GM20342 (minus strand) (FIG. 19B discloses SEQ ID NO: 6367 and 6368), FIG. 19C a heterozygous 12 bp insertion and homozygous substitution in sample GM17282 (plus strand) (FIG. 19C discloses SEQ ID NO: 6369 and 6370), and FIG. 19D compound heterozygous 6 and 12 bp deletions in sample GM00502 (minus strand) (FIG. 19D discloses SEQ ID NO: 6369 and 6370). Chromatogram trace offsets corresponding to specific heterozygous insertion and deletion patterns are indicated with slanted lines color coded by reference base. For clarity offsets are shown for FIGS. 19C-D only.
Figure 19B:
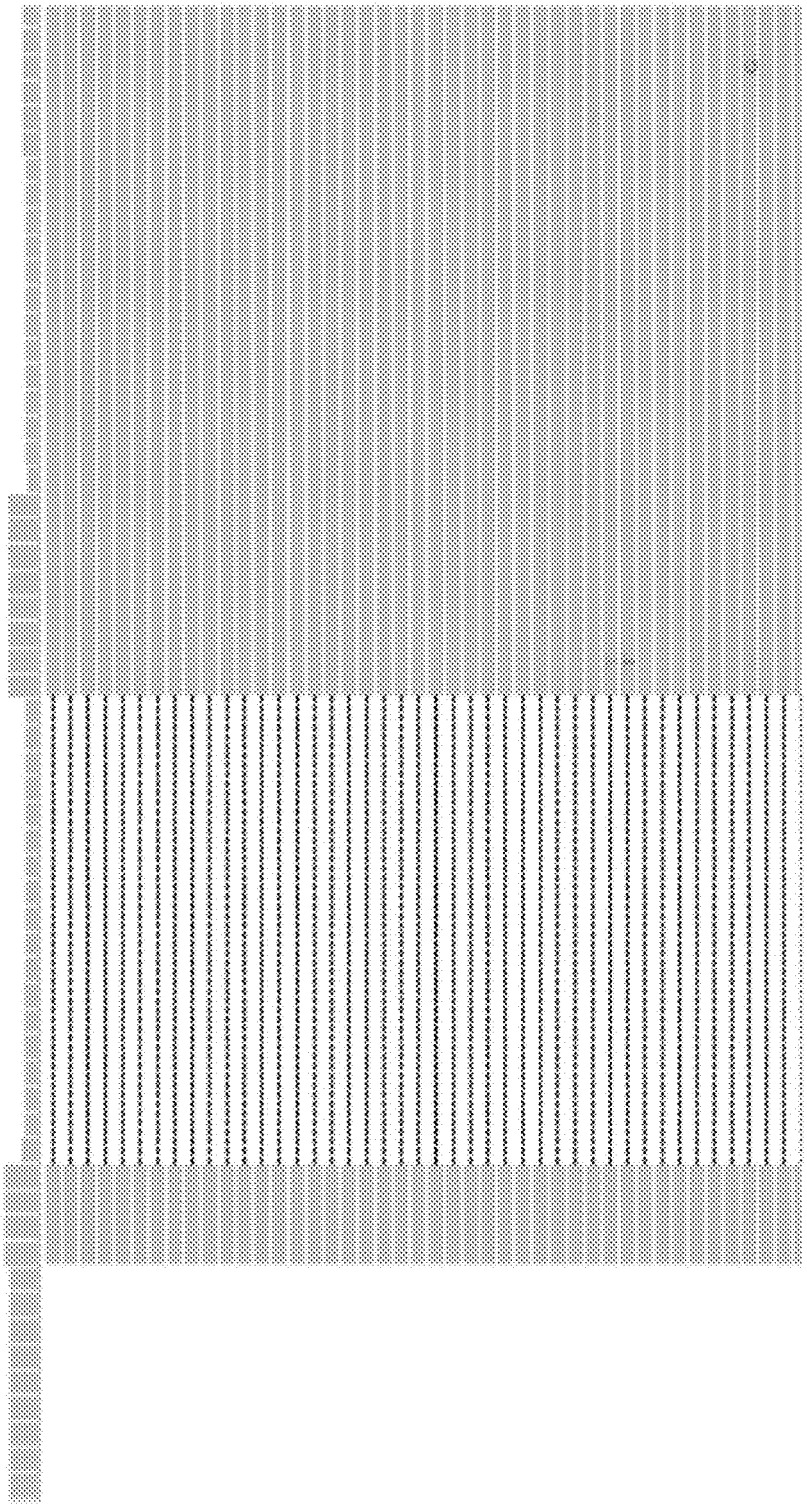
Figure 19B:
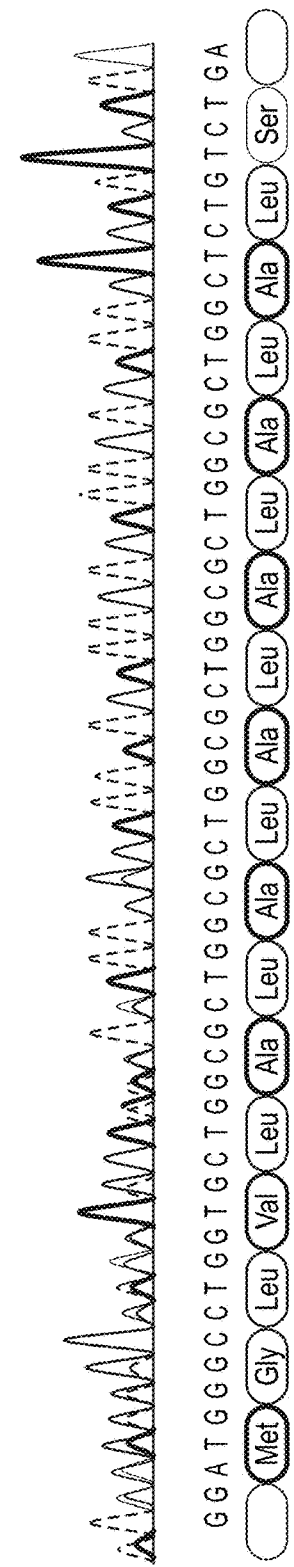
Figure 19C:
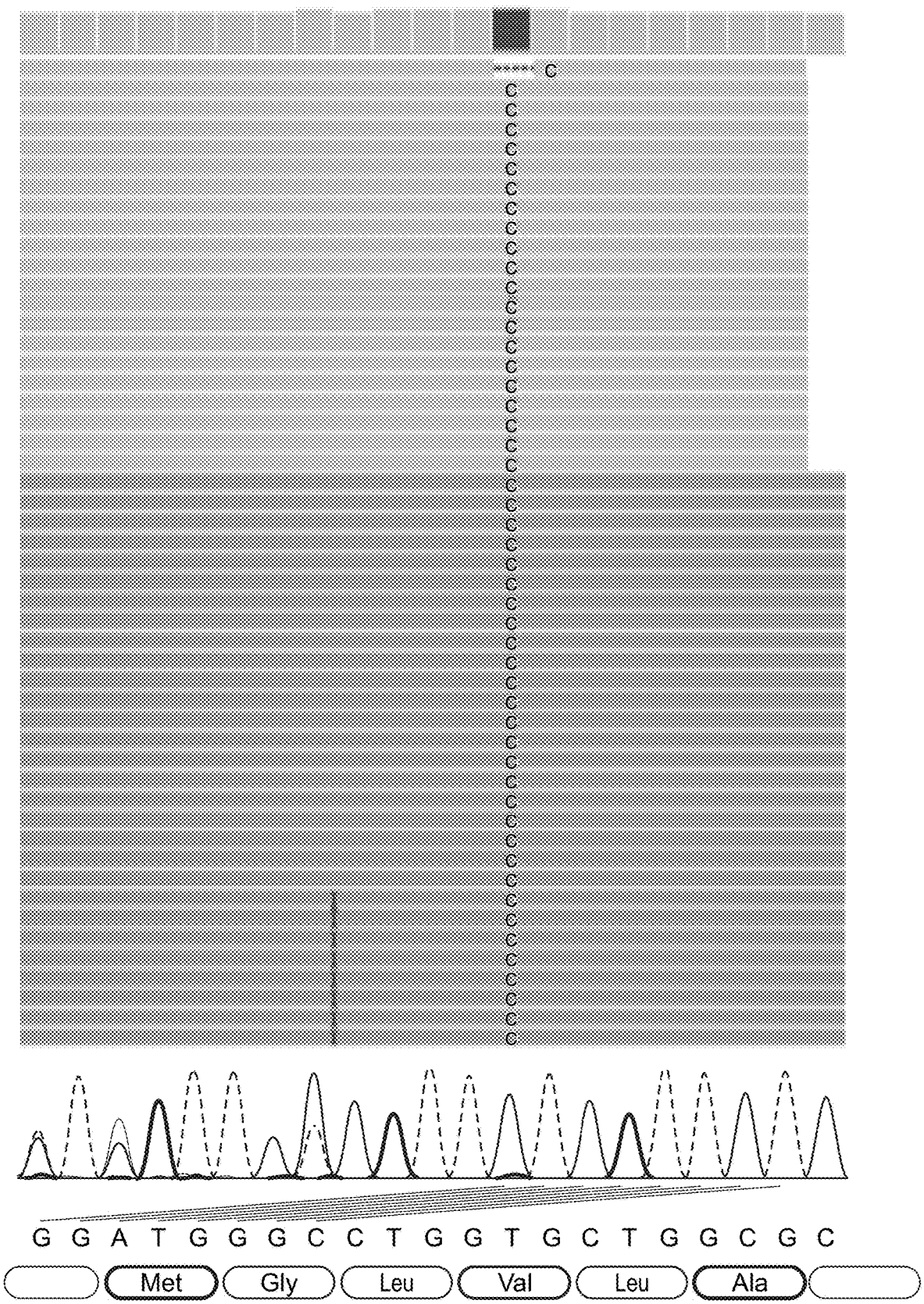
Figure 19D:
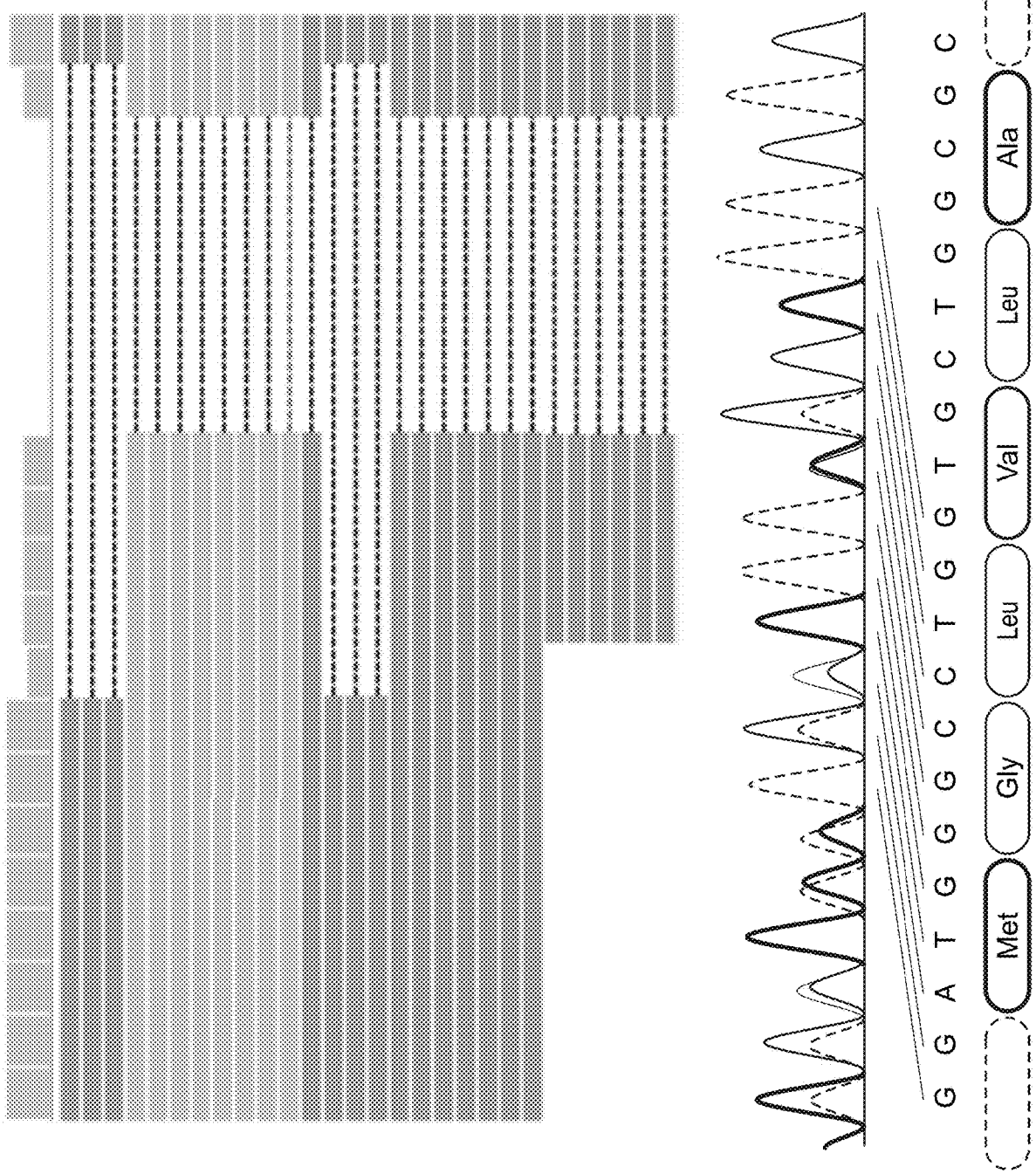

FIGS. 18A-E depicts the next-generation DNA sequencing workflow. Genomic DNA samples are input to a molecular inversion probe capture reaction. Each target (depicted as grey and black regions) is captured by multiple probes that anneal to non-overlapping genomic intervals. PCR is performed using primers containing patient-specific barcodes, yielding barcode libraries. Equal volumes of the libraries are pooled and enter Illumina's Hiseq high-throughput sequencing workflow as shown in FIG. 18B. Following sequencing, reads enter either the alignment only (AO, left) as depicted in FIG. 18C or Genotyping by Assembly-Templated Alignment (GATA, right) analysis pipeline as depicted in FIG. 18D. As shown in FIG. 18C, AO first partitions reads by sample molecular barcode, then in parallel for all samples performs short read alignment, base quality recalibration, realignment around putative indels, and genotyping. As shown in FIGS. 18D-E, GATA partitions reads first by sample molecular barcode, then by target. Reads are assembled into contigs that are then aligned to the reference genome. Raw reads are then aligned to the contigs, and raw read mapping and variant information relative to the reference is determined using reference-contig and read-contig alignments. Finally, base quality score recalibration and genotyping are performed on the mapped, raw reads.

The performance of GATA for indel genotyping was compared to the more conventional genotyping-by-alignment only (AO) algorithm used in the Sanger concordance studies. Across a set of 147 samples analyzed, both indel sensitivity and specificity were increased with GATA relative to AO (Table 9). GATA detected 23 unique insertions and deletions, which were confirmed by manual review of Sanger traces. Of these, 9 (39%) were not detected by AO in one or more samples, including BLM c.2207_2212delinsTAGATTC—the most common disease-causing mutation for Bloom syndrome in people of Ashkenazi Jewish descent—as well as several alleles in SMPD1 (Table 10), the gene associated with Niemann-Pick disease (FIGS. 19A-D). Performance for substitutions was identical for both detection methods (AO and GATA).

Table 9 shows genotyping by assembly-templated alignment (GATA) improves detection of insertions and deletions. Raw variant alleles (positive calls) from 147 samples were filtered by depth and strand bias and categorized according to NGS data analysis method, alignment only (AO) or GATA. Calls were classified with GATA considered truth as true positive (TP), false positive (FP), and false negative (FN). Discordant calls, in all cases, were confirmed by manual review of corresponding Sanger traces and found to be GATA TP or TN, rather than FP or FN. Variant calls flagged as low-confidence are considered uncalled. Polymorphisms in the first exon of SMPD1 accounted for the majority of uncalled and discordant alleles, which were not considered in accuracy calculations.

TABLE 9

| | O | ATA |
|---|---|---|
| TP | 04 | 11 |
| FP | 8 | |
| FN | 7 | |
| uncalled* | 0 | 0 |
| sensitivity | .696 | .0 |
| precision | .786 | .0 |

Table 10 shows the frequency distribution of variant genotypes for the STR at SMPD1 exon 1 representing various combinations of (i) the minor reference allele (0), (ii) a substitution (snp), (iii) insertions (+6 and +12 bp in length), and (iv) deletions (−6, −12, and −18 bp in length) as determined by GATA and confirmed by manual inspection of Sanger traces.

TABLE 10

| Genotype | Frequency |
|---|---|
| snp/snp | 42 |
| −6/snp | 41 |
| −6/−6 | 15 |
| −12/0 | 8 |
| snp/0 | 8 |
| −6/0 | 7 |
| −6/−12 | 7 |
| −12/snp | 4 |
| −18/0 | 3 |
| +12/snp | 2 |
| +6/snp | 2 |

TABLE 10-continued

| Genotype | Frequency |
|---|---|
| +6/0 | 1 |
| −12/−12 | 1 |

As seen in FIGS. 19A-D, GATA correctly genotypes insertions and deletions that are undetectable by the Alignment Only method. Read from top to bottom, each figure provides tracks for cumulative depth of coverage (vertical grey bars); representative MIP alignments (horizontal grey bars) with mismatches (letters), and gaps (dashed lines); chromatogram; reference DNA and amino acid sequence for FIG. 19A heterozygous BLM c.2207_2212delinsTAGATTC in sample GM04408 as well as several alleles in the first exon of SMPD1 including FIG. 19B a heterozygous 18 bp deletion in sample GM20342 (minus strand), FIG. 19C a heterozygous 12 bp insertion and homozygous substitution in sample GM1 7282 (plus strand), and FIG. 19D compound heterozygous 6 and 12 bp deletions in sample GM00502 (minus strand). Chromatogram trace offsets corresponding to specific heterozygous insertion and deletion patterns are indicated with slanted lines color coded by reference base. For clarity offsets are shown for FIG. 19C and FIG. 19D only.

Simulation to Assess Detectability of Rare Pathogenic Mutations

While detectability for all disease-causing mutations present in the sample set was empirically demonstrated, there exist a number of disease-causing mutations for which samples cannot be readily obtained. To assess whether the NGS workflow can detect these additional mutations, the stimulations were performed in silico. Since detectability can be affected by any element of the workflow, a simulator was implemented that employed read sets from actual samples rather than model reads derived from the reference genome at uniform coverage. This allowed for realistic representation of target abundance distribution, neighboring in cis variants, as well as cycle- and context-dependent sequencing errors. Disease-causing variants were introduced into raw reads by a Bernoulli process, with an average 0.5 probability of introducing the lesion, to simulate the heterozygous genotypes carrier screening aims to detect.

A total of 81 heterozygous variants were simulated in a read set of at least 144 samples with the exception of c.1521_1523delCTT (F508del), the most common disease-causing mutation for cystic fibrosis in Caucasian populations, as shown in Table 11. This mutation was present in several samples, which were removed from simulation analysis (Materials and Methods). Of the simulated variants 67 (83%) were correctly genotyped in all (generally 145/145) samples and only four relatively large (>7 bp) deletions were undetected in one or more samples. High-confidence genotype calls were not made for the remaining 10 variants. No variants were found to be undetectable in all samples. Table 11 gives the performance results of GATA for detecting clinically-relevant mutations by simulation.

TABLE 11

| Variant | Samples Simulated | Variant Positive | Variant Uncalled | Variant Negative |
|---|---|---|---|---|
| BLM c.2207_2212delinsTAGATTC | 146 | 146 | 0 | 0 |
| CFTR c.1923_1931delCTCAAAACTinsA | 147 | 147 | 0 | 0 |
| CFTR c.1973_1985del13insAGAAA | 146 | 146 | 0 | 0 |
| CFTR c.723_743 + 1delGAGAATGATGATGAAGTACAGG (SEQ ID NO: 6325) | 147 | 147 | 0 | 0 |
| CFTR c.3067_3072delATAGTG | 147 | 147 | 0 | 0 |
| CFTR_c.650_659delAGTTGTTACA (SEQ ID NO: 6326) | 145 | 145 | 0 | 0 |
| CFTR_c.1871_1878delGCTATTTT | 145 | 145 | 0 | 0 |
| CFTR_c.739_742dupTACA | 145 | 145 | 0 | 0 |
| CFTR_c.578_579 + 5delAAGTATG | 145 | 145 | 0 | 0 |
| CFTR_c.3421_3424dupAGTA | 145 | 145 | 0 | 0 |
| BLM_c.991_995del5 | 145 | 145 | 0 | 0 |
| CFTR_c.2589_2599delAATTTGGTGCT (SEQ ID NO: 6327) | 145 | 46 | 7 | 92 |
| CFTR_c.3664_3665insTCAA | 145 | 145 | 0 | 0 |
| CFTR_c.2634_2641delGGTTGTGC | 145 | 143 | 1 | 1 |
| CFTR_c.156_163dupATTGGAAA | 145 | 145 | 0 | 0 |
| CFTR_c.522_526delAATAA | 145 | 145 | 0 | 0 |
| ABCC8_c.259_268del10 | 145 | 141 | 3 | 1 |
| CFTR_c.1616_1617dupTA | 145 | 145 | 0 | 0 |

TABLE 11-continued

| Variant | Samples Simulated | Variant Positive | Variant Uncalled | Variant Negative |
|---|---|---|---|---|
| CFTR_c.3068_3072delTAGTG | 145 | 145 | 0 | 0 |
| FANCC_c.356_360del5 | 145 | 145 | 0 | 0 |
| CFTR_c.861_865delCTTAA | 145 | 145 | 0 | 0 |
| ABCC8_c.2835_2838delGAGA | 145 | 145 | 0 | 0 |
| CFTR_c.319_326delGCTTCCTA | 145 | 145 | 0 | 0 |
| CFTR_c.2249_2256del8 | 145 | 145 | 0 | 0 |
| CFTR_c.1792_1798delAAAACTA | 145 | 145 | 0 | 0 |
| CFTR_c.2241_2248delGATACTGC | 145 | 145 | 0 | 0 |
| G6PC_c.462_466delTTTGT | 145 | 145 | 0 | 0 |
| CFTR_c.35_36insTATCA | 145 | 145 | 0 | 0 |
| HEXA_c.1471_1475delTCTGA | 145 | 145 | 0 | 0 |
| PCDH15_c.996_999delGGAT | 145 | 145 | 0 | 0 |
| ASPA_c.568_574del7 | 145 | 144 | 0 | 1 |
| CFTR_c.3184_3188dupCTATG | 145 | 145 | 0 | 0 |
| SMPD1_c.1657_1663delACCGCCT | 145 | 145 | 0 | 0 |
| CFTR_c.1162_1168delACGACTA | 145 | 145 | 0 | 0 |
| BCKDHB_c.163_166dupACTT | 145 | 145 | 0 | 0 |
| BCKDHA_c.861_868delAGGCCCCG | 145 | 145 | 0 | 0 |
| CFTR_c.3773dupT | 145 | 145 | 0 | 0 |
| CFTR_c.1155_1156dupTA | 145 | 145 | 0 | 0 |
| CFTR_c.3889dupT | 145 | 145 | 0 | 0 |
| HEXA_c.1274_1277dupTATC | 145 | 145 | 0 | 0 |
| CFTR_c.262_263delTT | 244 | 144 | 0 | 0 |
| CFTR_c.326_327delAT | 245 | 145 | 0 | 0 |
| CFTR_c.3691delT | 145 | 145 | 0 | 0 |
| CFTR_c.3528delC | 144 | 144 | 0 | 0 |
| BLM_c.2407dupT | 145 | 145 | 0 | 0 |
| CFTR_c.1521_1523delCTT | 131 | 131 | 0 | 0 |
| HEXA_c.915_917delCTT | 145 | 145 | 0 | 0 |
| G6PC_c.379_380dupTA | 145 | 145 | 0 | 0 |
| CFTR_c.2012delT | 144 | 144 | 0 | 0 |
| SMPD1_c.1829_1831delGCC | 144 | 144 | 0 | 0 |
| CFTR_c.1029delC | 145 | 127 | 18 | 0 |
| CFTR_c.2737_2738insG | 145 | 145 | 0 | 0 |
| CFTR_c.2947_2948delTT | 145 | 142 | 3 | 0 |
| CFTR_c.1911delG | 145 | 145 | 0 | 0 |
| CFTR_c.803delA | 145 | 145 | 0 | 0 |
| CFTR_c.1519_1521delATC | 145 | 145 | 0 | 0 |
| CFTR_c.805_806delAT | 145 | 18 | 127 | 0 |

TABLE 11-continued

| Variant | Samples Simulated | Variant Positive | Variant Uncalled | Variant Negative |
|---|---|---|---|---|
| CFTR_c.2215delG | 145 | 137 | 8 | 0 |
| FANCC_c.67delG | 145 | 145 | 0 | 0 |
| CFTR_c.935_937delTCT | 145 | 145 | 0 | 0 |
| CFTR_c.2175dupA | 145 | 145 | 0 | 0 |
| CFTR_c.3530delA | 145 | 145 | 0 | 0 |
| CFTR_c.531delT | 145 | 145 | 0 | 0 |
| CFTR_c.1021_1022dupTC | 145 | 127 | 18 | 0 |
| CFTR_c.3659delC | 145 | 145 | 0 | 0 |
| DLD_c.104dupA | 144 | 144 | 0 | 0 |
| CFTR_c.2052dupA | 144 | 144 | 0 | 0 |
| CFTR_c.313delA | 145 | 145 | 0 | 0 |
| G6PC_c.79delC | 145 | 145 | 0 | 0 |
| CFTR_c.442delA | 145 | 145 | 0 | 0 |
| CFTR_c.1477_1478delCA | 145 | 145 | 0 | 0 |
| CFTR_c.1545_1546delTA | 145 | 145 | 0 | 0 |
| BCKDHA_c.117delC | 145 | 145 | 0 | 0 |
| CFTR_c.1418delG | 145 | 145 | 0 | 0 |
| CFTR_c.1976delA | 145 | 145 | 0 | 0 |
| CFTR_c.3536_3539delCCAA | 145 | 145 | 0 | 0 |
| CFTR_c.948delT | 145 | 145 | 0 | 0 |
| CFTR_c.2052delA | 145 | 145 | 0 | 0 |
| BCKDHB_c.595_596delAG | 145 | 145 | 0 | 0 |
| G6PC_c.980_982delTCT | 145 | 145 | 0 | 0 |
| CFTR_c.3039delC | 145 | 145 | 0 | 0 |

DISCUSSION

Robustness, completeness, and accuracy are three of the main factors that define the utility of a genetic carrier testing workflow in a clinical laboratory. By utilizing a target enrichment methodology that is performed in a single tube and requires no mechanical shearing or purifications of individual samples, methods of the invention provide an automated NGS workflow that yields highly-reproducible results across samples and operators. This reproducibility ensures that samples will not have to be rerun frequently, minimizing both turnaround time and per-sample cost.

Because each clinically meaningful basepair must be sequenced before an actionable medical report can be generated, a high level of completeness minimizes the amount of costly re-work necessary for a sample. Methods of the invention demonstrate completeness that is consistent with low to no re-work for the samples studied, and substantially better than other previously-reported methods using multiplex target capture or PCR with NGS. This improvement is likely the result of a number of optimizations we have made relative to previous reports including the use of a tiling MIP design that ensures multiple probes capture each base and the use of a DNA extraction protocol that effortlessly shears the DNA to a lower molecular mass.

Regarding accuracy, the only observed SNV false negative was in a sample that exhibited skewed allele ratios along the chromosome, which should not commonly occur when testing for germline mutations in clinical specimens derived from whole blood. Additionally, the SNV false positive rate of approximately 1.1 per million basepairs corresponds to a low confirmation burden for clinical testing and surpasses values previously reported. Given the small target set and the rare nature of indels, it is difficult to give a precise measurement of our accuracy for indels in genera. However, this data suggests that the use of GATA substantially improves our ability to detect small lesions. Additionally, a sensitivity of 100% by both AO and GATA was observed across the set of disease-causing insertions and deletions in carrier and affected samples.

It is worth noting that measuring accuracy to a sufficient level of precision and generality can be challenging within conserved coding regions because selective pressure limits the spectrum of variation present. While a large number of samples were sequenced, the relatively small size of our target limited the number of unique alleles observable and meant that approximately 90% of such variants were common (i.e. present in dbSNP). Nonetheless, there is no a priori reason to believe that the measured accuracy will not generalize to other rare and private mutations present in the targeted loci. Supporting this point, these simulations using real data and controlled for sample-to-sample variability indicate that one can detect a number of very rare disease causing alleles of different types and sequence contexts, including insertions (up to 12 bp), deletions (up to 22 bp) and complex combinations thereof.

Figures 1, 20A:
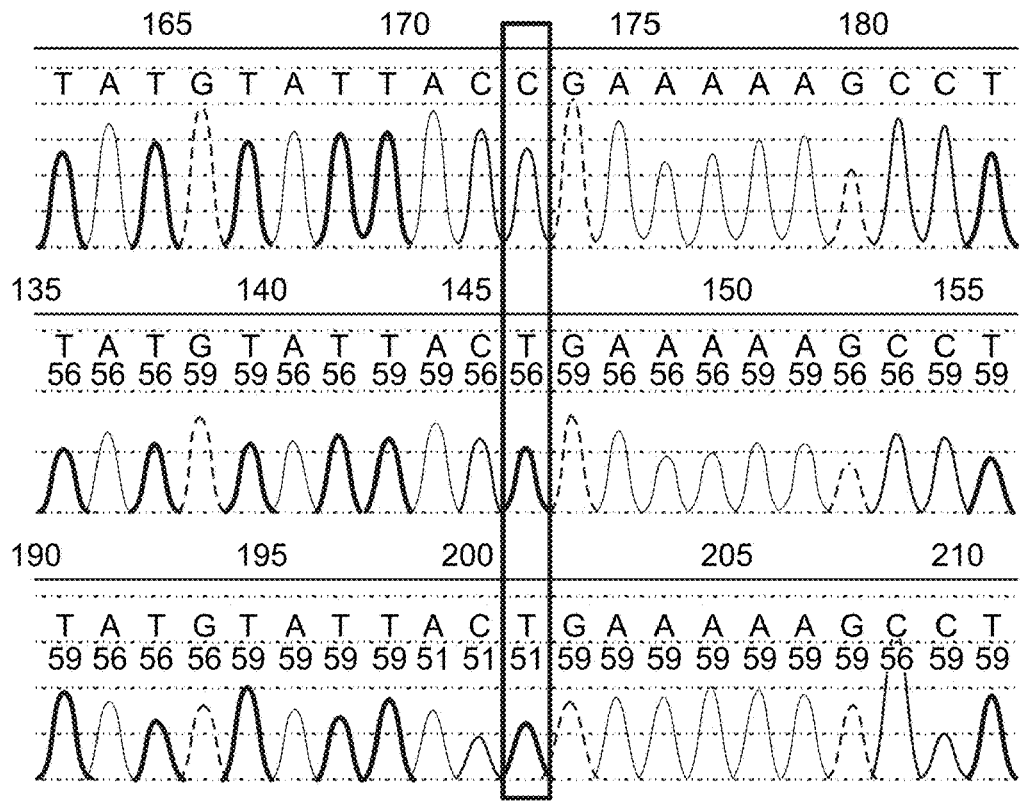
Figures 2, 20A:
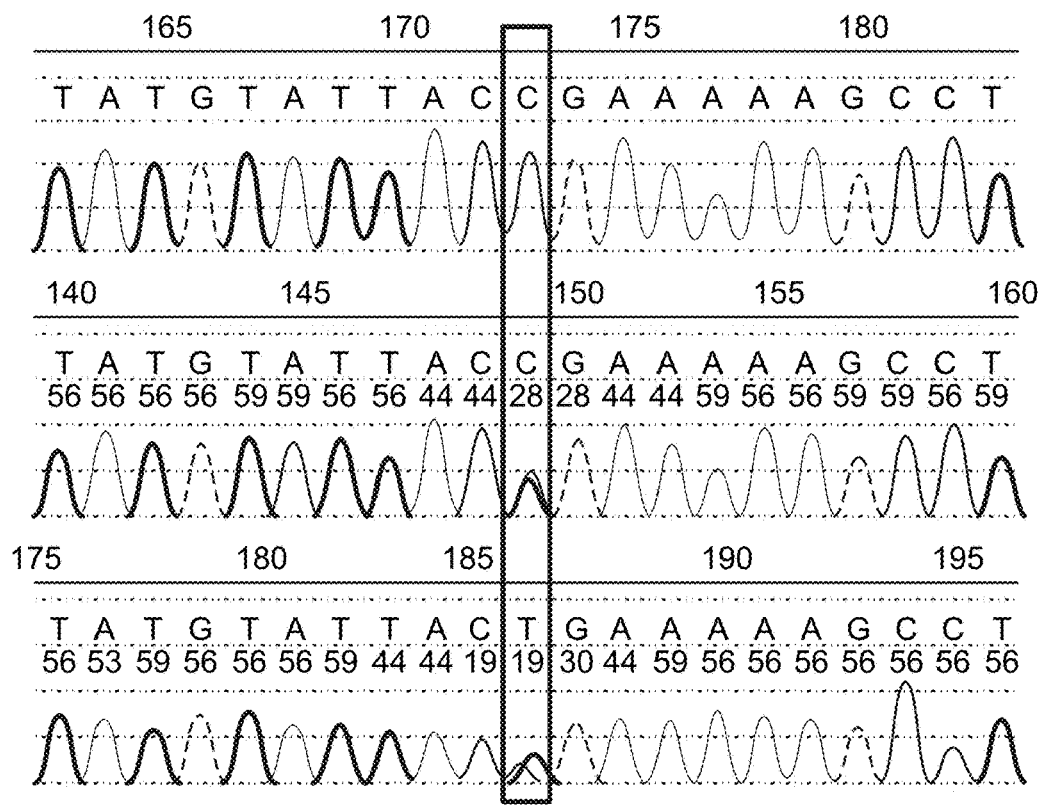
Figures 3, 20A:
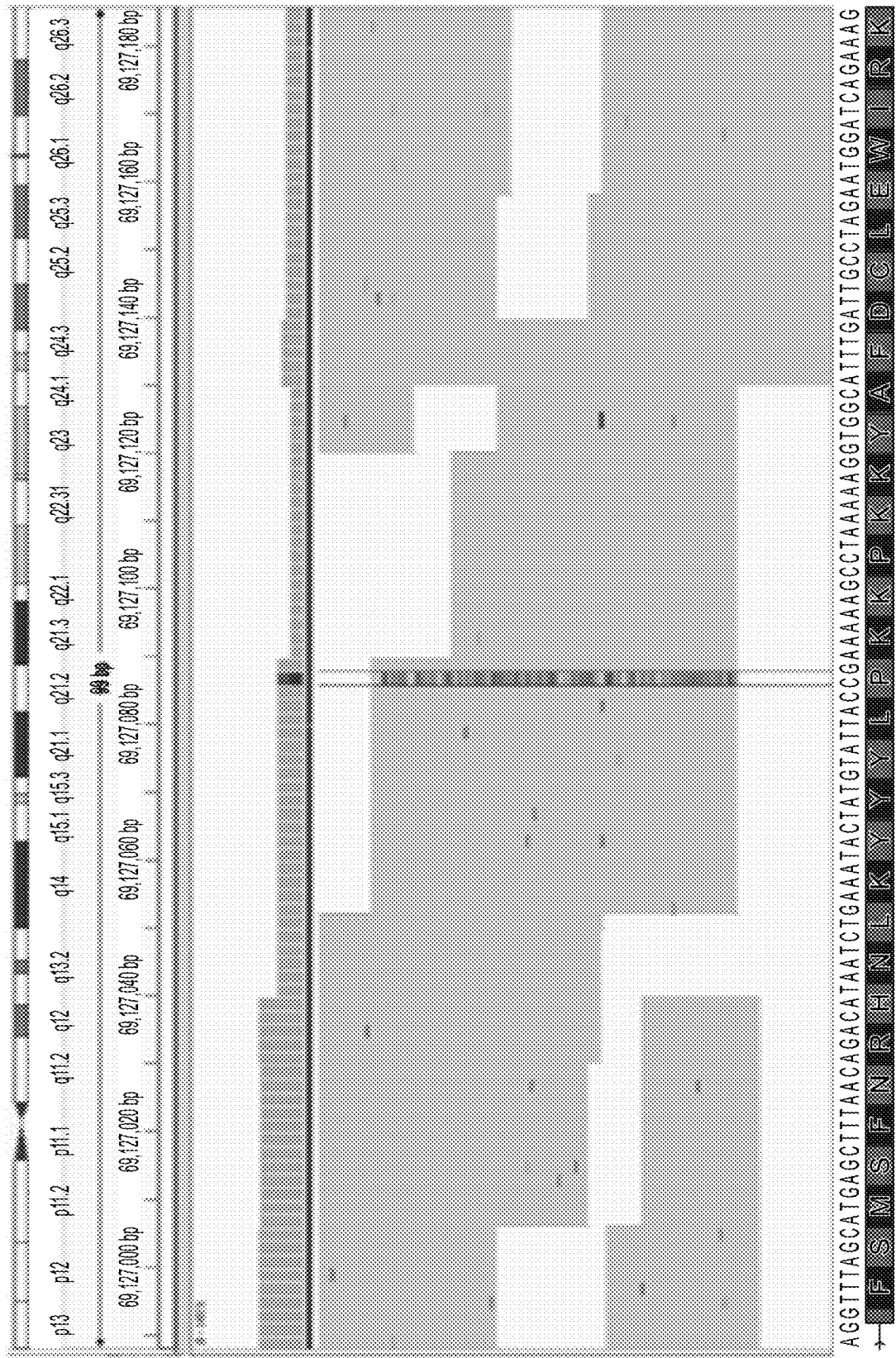
Figures 1, 20B:
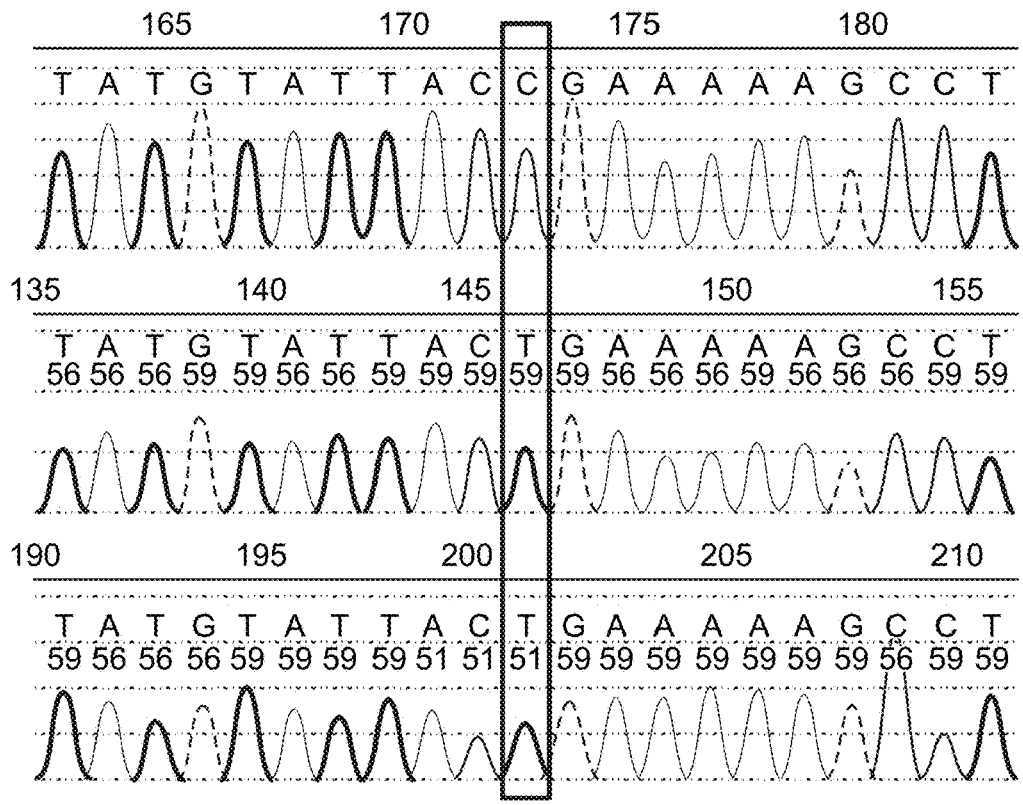
Figures 2, 20B:
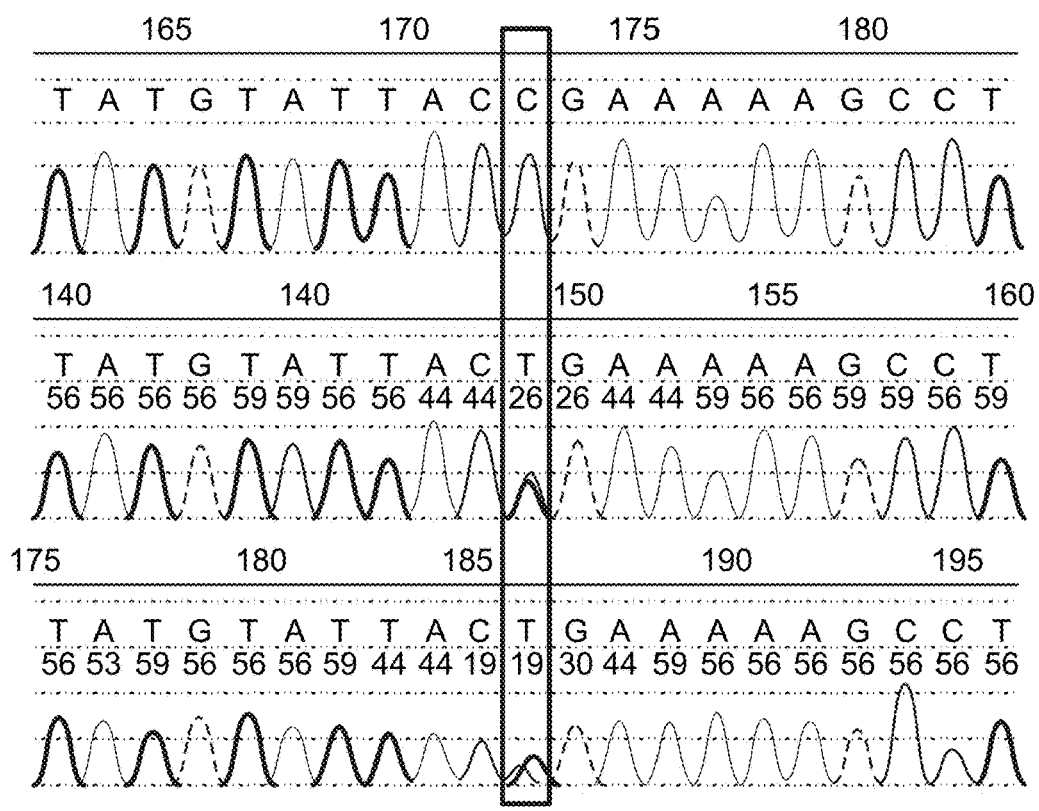
Figures 3, 20B:
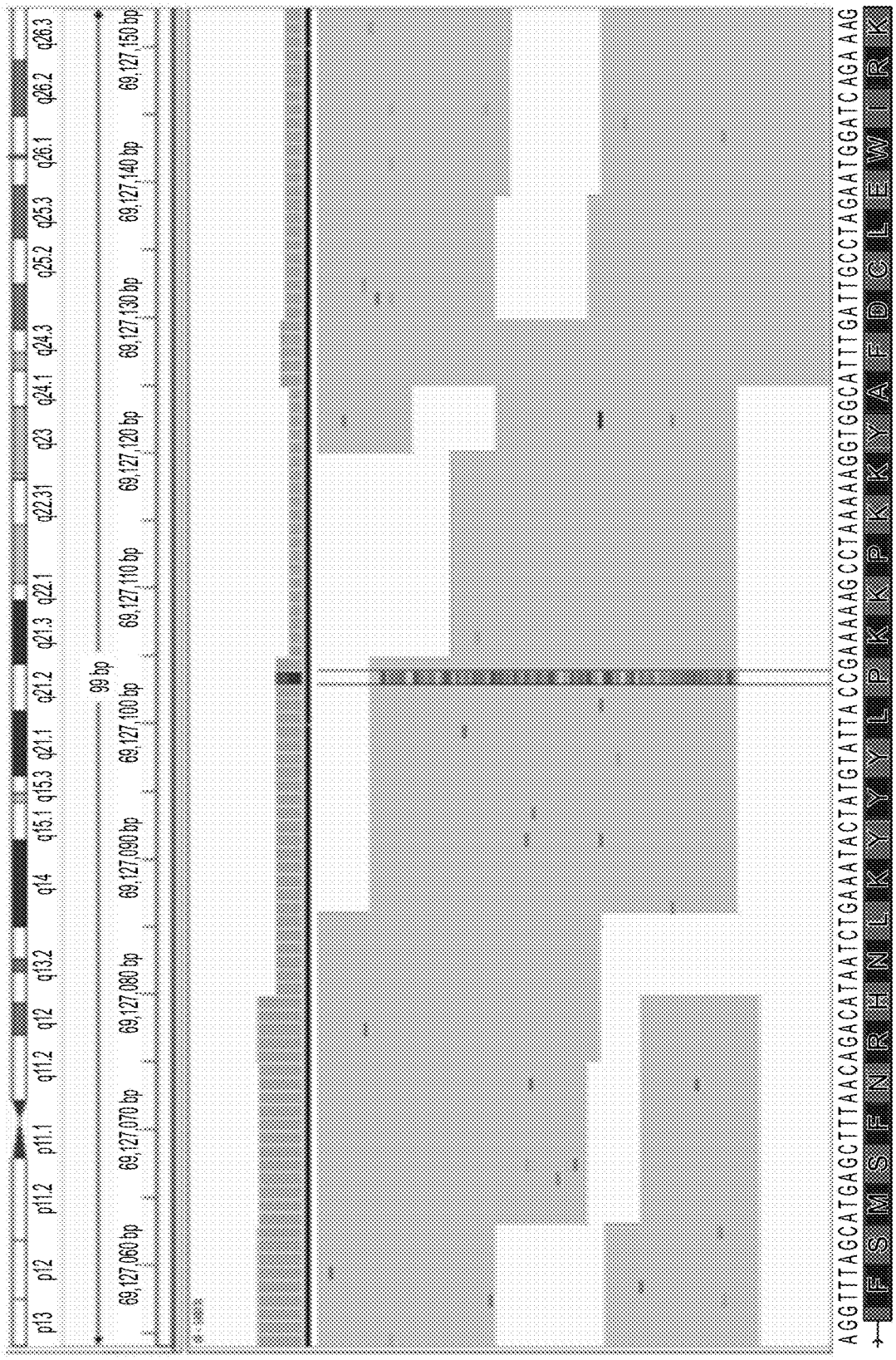

The reference standard one considers ground truth can impose a ceiling on measurable accuracy. Automated analysis of what is widely deemed the 'gold standard' for DNA sequencing was employed: bi-directional Sanger traces derived from PCR amplicons. FIGS. 20A-20B shows NGS detects allele dropout in Sanger sequencing reactions. FIG. 20A-1, FIG. 20A-2, and FIG. 20A-3 show dropout of reference allele leads to homozygous non-reference call by Sanger sequencing, but heterozygous non-reference call by NGS, in BLM exon 12 of GM18034. Shown from top to bottom, (FIG. 20A-1) original PCR primer pair: expected reference sequence trace, sample forward trace, sample reverse trace; (FIG. 20A-2) re-designed PCR primer pair: expected reference sequence trace, sample forward trace, sample reverse trace; IGV of NGS data.

FIG. 20B-1, FIG. 20B-2, and FIG. 20B-3 shows dropout of non-reference allele leads to homozygous reference call by Sanger sequencing, but heterozygous non-reference call by NGS, in DLD exon 9 of sample GM11370. Shown from top to bottom, expected reference sequence trace, sample forward trace, sample reverse trace. Shown from top to bottom, (FIG. 20B-1) original PCR primer pair: expected reference sequence trace, sample forward trace, sample reverse trace; (FIG. 20B-2) re-designed PCR primer pair: expected reference sequence trace, sample forward trace, sample reverse trace; IGV of NGS data. Project genotyping data was employed, 12 NGS false negatives and 7 false positives would have been observed in the subset of samples characterized by this approach. Because these were all shown by Sanger analysis to be HapMap Project genotyping errors, this would have underestimated both sensitivity and specificity.

The NGS workflow detected allele dropout in the Sanger data, a known limitation of that technology (FIGS. 20A-1 through 20B-3) and not surprising since each base sequenced by NGS was captured by multiple probes with independent targeting arms. Had the less laborious and more commonly-used reference of Hapmap Project genotyping data been employed, 12 NGS false negatives and 7 false positives would have been observed in the subset of samples characterized by this approach (Table 12). This would have underestimated both sensitivity and specificity.

Table 12 shows concordance of NGS genotypes with HapMap data. All NGS positions called with high confidence (minimum 50× coverage and strand bias <=0) that intersected Hapmap release 27 phase II+III genotyping data were evaluated, for a total of 5,337 genotypes across 83 samples. True negative: reference called by both NGS and HapMap; true positive: non-reference (heterozygous or homozygous) called by both NGS and HapMap; false positive: non-reference called by NGS, reference called by HapMap; false negative: reference called by NGS, non-reference called by HapMap. Specificity: TN/(TN+FP); sensitivity: TP/(TP+FN).

TABLE 12

| | |
|---|---|
| True negatives | 4,233 |
| True positives | 1,085 |
| False positives | 7 |
| False negatives | 12 |
| Specificity | 0.998 |
| Sensitivity | 0.989 |

Indel detection methods that only employ gapped alignment of short reads to reference are often limited by false positives introduced by systematic, context-dependent sequencing error, and false negatives introduced by failure of the aligner to open or extend gaps. An assembly-based paradigm would address these limitations but raw contigs do not always carry base quality and coverage information. The GATA algorithm combines these approaches to deliver sensitive and specific indel detection with SNV performance on par with a traditional alignment-only pipeline.

Many alleles detected exclusively by GATA were from a short tandem repeat (STR) region encoding the N-terminal signal peptide in SMPD1 (Table 10). Consistent with previous reports, GATA detected non-reference alleles in 96% of samples, a rate that is strikingly high because hg18 contains a minor allele that is frequently substituted (V36A). While common hexanucleotide indels at this locus are clinically benign, any pathogenic mutation present in cis would likely be missed using a conventional approach for variant detection. Indeed, when reads were aligned independently, several genomic positions in this region consistently fell below our specified coverage threshold. GATA therefore should yield higher sensitivity for rare mutations linked to polymorphisms in the first exon of SPMD1 and potentially other STR loci as well.

The simulation methodology applied here attempts to assess detectability of rare pathogenic mutations in a highly realistic manner. Simply deriving reads from a reference genome modified to include the mutation of interest can overestimate the detection probability because of real-world factors that would otherwise render the mutation undetectable. Additionally, we are able to determine whether a mutation is sometimes, rather than always or never, detectable because it is simulated in the read sets of hundreds of samples; e.g., this could occur in a particular genetic background with a low-frequency in cis variant that interferes with alignment of reads containing the mutation. Nonetheless, certain mutation types, in particular large deletions are still not amenable to this paradigm because they could fundamentally alter the distribution of reads generated across the relevant region. In these cases, either human samples or synthetic templates remain the only way to assess detectability.

In conclusion, an automated, integrated workflow that converts human genomic DNA isolated from blood or cell lines into clinically-relevant variant calls was presented by this example. High genotype concordance was achieved with conventional electrophoretic sequencing across a set of 15 genes. In addition, this example demonstrates the ability to detect a range of important disease-causing mutations. The pipeline analysis presented allows for sensitive and specific detection of indels, while simultaneously incorporating raw base quality and coverage into SNV genotype calls. Realistic simulation on actual run data indicates that a number of pathogenic mutations undetectable by a traditional alignment-based genotyping approach are accessible by GATA. Collectively, the data shows that this workflow has met three of the major requirements of a clinical carrier screening assay, supporting the notion that NGS is ready for clinical use.

It should be appreciated that the preceding examples are non-limiting and aspects of the invention may be implemented as described herein using alternative techniques and/or protocols that are available to one or ordinary skill in the art.

It will be clear that the methods may be practiced other than as particularly described in the foregoing description and examples. Numerous modifications and variations of the present disclosure are possible in light of the above teachings and, therefore, are within the scope of the claims. Preferred features of each aspect of the disclosure are as for each of the other aspects mutatis mutandis. The documents including patents, patent applications, journal articles, or other disclosures mentioned herein are hereby incorporated by reference in their entirety. In the event of conflict, the disclosure of present application controls, other than in the event of clear error.

Lengthy table referenced here

US12129514-20241029-T00001

Please refer to the end of the specification for access instructions.

Lengthy table referenced here

US12129514-20241029-T00002

Please refer to the end of the specification for access instructions.

LENGTHY TABLES

The patent contains a lengthy table section. A copy of the table is available in electronic form from the USPTO web site (https://seqdata.uspto.gov/?pageRequest=docDetail&DocID=US12129514B2). An electronic copy of the table will also be available from the USPTO upon request and payment of the fee set forth in 37 CFR 1.19(b)(3).

SEQUENCE LISTING (6378 sequences)

SEQ ID NO: 1 - DNA, 52 bp, Homo sapiens
tcacatcaccaagttaaaaaaaaaaarggggcgggggggcagaatgaaaatt

SEQ ID NO: 2 - DNA, 52 bp, Homo sapiens
  modified_base (27)..(27): May or may not be present
aaacaaggatgaattaagtttttttttaaaaaagaaacatttggtaagggga

SEQ ID NO: 3 - DNA, 52 bp, Homo sapiens
atcaccaagttaaaaaaaaaaaagggrcgggggggcagaatgaaaattgcat

SEQ ID NO: 4 - DNA, 52 bp, Homo sapiens
ctattgaaccagaaccaaacaggaatrccatagcattttgtaaactaaactg

SEQ ID NO: 5 - DNA, 52 bp, Homo sapiens
caggagttcaagaccagcctactaaamcacacacacacacacacacacacac

SEQ ID NO: 6 - DNA, 52 bp, Homo sapiens
gattaaataatagtgtttatgtacccsgcttataggagaagagggtgtgtgt

SEQ ID NO: 7 - DNA, 52 bp, Homo sapiens
attgttatcttttcatataaggtaacwgaggcccagagagattaaataacat

SEQ ID NO: 8 - DNA, 52 bp, Homo sapiens
taattttaattaagtaaatttaattgrtagataaataagtagataaaaaata

SEQ ID NO: 9 - DNA, 52 bp, Homo sapiens
gtataaaaaaaaaaaaaaaaaaagttwgaatgttttcttgcattcagagcct

SEQ ID NO: 10 - DNA, 52 bp, Homo sapiens
atactaaaaatttaaagttctcttgcratatattttcttaatatcttacatc

SEQ ID NO: 11 - DNA, 52 bp, Homo sapiens
tgctgggattacaggcgtgagccaccrcgcctggcctgatgggacatatttt

SEQ ID NO: 12 - DNA, 52 bp, Homo sapiens
ctacaatataagtatagtattgcaaamccatcaggaagggtgttaactattt

SEQ ID NO: 13 - DNA, 54 bp, Homo sapiens
  misc_feature (27)..(29): This region may or may not be present in its entirety
gttgtctccaaactttttttcaggtgagaaggtggccaaccgagcttcggaaag

SEQ ID NO: 14 - DNA, 52 bp, Homo sapiens
ttttttcataaaagattatataaaggmtattgcttttgaatcacaaacacta

SEQ ID NO: 15 - DNA, 52 bp, Homo sapiens
atctagtgagcagtcaggaaagagaayttccagatcctggaaatcagggtta

SEQ ID NO: 16 - DNA, 52 bp, Homo sapiens
  modified_base (27)..(27): May or may not be present
tagagtataaaaaaaaaaaaaaaaaaagtttgaatgttttcttgcattcaga

SEQ ID NO: 17 - DNA, 52 bp, Homo sapiens
tgcaaatgccaactatcaaagatattsgagtatactgtcaataaacttcata

SEQ ID NO: 18 - DNA, 52 bp, Homo sapiens
tcctcaacagttagaaacaatattttsagtgatttcccatgccaactttact

SEQ ID NO: 19 - DNA, 52 bp, Homo sapiens
tttttggtattgttgttaaataagtgrgaattcaatacagtataatgtctgt

SEQ ID NO: 20 - DNA, 97 bp, Homo sapiens
  misc_feature (27)..(72): This region may or may not be present in its entirety
cttgaaatcggatatatatatatatatgtatatatatatatatatatatatatatatacatatatatatatagtattatccctgttttcacagtttt

SEQ ID NO: 21 - DNA, 52 bp, Homo sapiens
agaggggctgtgaaggacaccaaggargagactaagagccaggagggaaaac

SEQ ID NO: 22 - DNA, 52 bp, Homo sapiens
tagagtttattagcttttactactctrcttagttactttgtgttacagaata

SEQ ID NO: 23 - DNA, 53 bp, Homo sapiens
  misc_feature (27)..(28): This region may or may not be present in its entirety
actagtgatgatgagcttcttttcatatgtttgttggctgcataaatgtcttc

SEQ ID NO: 24 - DNA, 52 bp, Homo sapiens
gcagagaaaagaggggctgtgaaggasaccaaggaggagactaagagccagg

SEQ ID NO: 25 - DNA, 52 bp, Homo sapiens
ttcagaggtctaccactggtgcatackctaatcacagtgtcgaaaattttac

SEQ ID NO: 26 - DNA, 52 bp, Homo sapiens
aagaaagagcaaaagagggcaaacttytcatacatttttgatgtcgaaacca

SEQ ID NO: 27 - DNA, 52 bp, Homo sapiens
  modified_base (27)..(27): May or may not be present
cctaaagtttaaaaagaaaaaaaaaaaggaagaaggaattaaaaatccaaag

SEQ ID NO: 28 - DNA, 52 bp, Homo sapiens
gtgtgtgtgtgtatatatatatatatwtatatattttttttttcctgagcca

SEQ ID NO: 29 - DNA, 52 bp, Homo sapiens
aaactgttgatgttttcatttatttasatcattggaaaactttagattctag

SEQ ID NO: 30 - DNA, 52 bp, Homo sapiens
tttatccattcttaaccagaacagacrttttttcagagctggtccaggaaaa

SEQ ID NO: 31 - DNA, 52 bp, Homo sapiens
ttgaaatcggatatatatatatatatrtatatatatatatatatatatatat

SEQ ID NO: 32 - DNA, 53 bp, Homo sapiens
  modified_base (27)..(27): May or may not be present
tagttttttatttcctcatattattttcagtggcttttttcttccacatcttt

SEQ ID NO: 33 - DNA, 52 bp, Homo sapiens
acatagttctcagtggtacaactacargtgatttctcttttcttatttctgg

SEQ ID NO: 34 - DNA, 52 bp, Homo sapiens
agagcaatggcatcccttgtcttgtgytatacaggatgcagcaatttatagg

SEQ ID NO: 35 - DNA, 52 bp, Homo sapiens
ttctgtctacataagatgtcatactarattatcttttccagcatgcattcag

SEQ ID NO: 36 - DNA, 52 bp, Homo sapiens
cagggtggcatgttaggcagtgcttaraataaatgagttggttatacaagta

SEQ ID NO: 37 - DNA, 53 bp, Homo sapiens
  misc_feature (27)..(28): This region may or may not be present in its entirety
aggacacacacacacacacacacacacatgcacacacatttaaatagatgcat

SEQ ID NO: 38 - DNA, 52 bp, Homo sapiens
taaaaaattggtataatgaaattgcayttgtagtctttggacatttaaatcc

SEQ ID NO: 39 - DNA, 52 bp, Homo sapiens
tttcaatacttaagaggtacgcagagraaagaggggctgtgaaggacaccaa

SEQ ID NO: 40 - DNA, 52 bp, Homo sapiens
cagcaatgaatattttgaggctgaggygctgaggggtaaaattgcagcctgg

SEQ ID NO: 41 - DNA, 54 bp, Homo sapiens
  misc_feature (26)..(29): This region may or may not be present in its entirety
ttatggtttatattttgtgtcttctctttaacacatcttttctagcagaattca

SEQ ID NO: 42 - DNA, 52 bp, Homo sapiens
  modified_base (27)..(27): May or may not be present
gtattttagttttttttttttgtttgttttgttttgttttgttttgtttttg

SEQ ID NO: 43 - DNA, 52 bp, Homo sapiens
tgggtgactccatttttacttttagtytggtctgttgaggcctcgtgagaga

SEQ ID NO: 44 - DNA, 56 bp, Homo sapiens
  misc_feature (28)..(31): This region may or may not be present in its entirety
tattttcatgtattttagtttttttttttttgtttgttttgttttgttttgttttg

SEQ ID NO: 45 - DNA, 52 bp, Homo sapiens
gtgtgtgtgtatatatatatatatatwtatattttttttttcctgagccaaa

SEQ ID NO: 46 - DNA, 52 bp, Homo sapiens
  modified_base (27)..(27): May or may not be present
aacctattagcatgtctggcagaaaaatagatacttaataaatttcttaaat

SEQ ID NO: 47 - DNA, 52 bp, Homo sapiens
gaggcttagacagtttaagtaactcargcatggttacacaactagctagggc

SEQ ID NO: 48 - DNA, 52 bp, Homo sapiens
gtgtgagtattatgagaccatatgttrggagattttatttggtattgaggat

SEQ ID NO: 49 - DNA, 52 bp, Homo sapiens
gaaaccccaccccttctatagttttcyctttaatatttacaatggaaccatt

SEQ ID NO: 50 - DNA, 52 bp, Homo sapiens
catatatatatagtgtgtgtgtgtgtrtatatatatatatatatatattttt

SEQ ID NO: 51 - DNA, 53 bp, Homo sapiens
  misc_feature (27)..(28): This region may or may not be present in its entirety
cgagcgagagagagagagagagagagaggagccggcgcgagaactacgcatgc

SEQ ID NO: 52 - DNA, 52 bp, Homo sapiens
ggcaggtaatatctagtaccttacttwtatttcctgagcacattctacattt

SEQ ID NO: 53 - DNA, 52 bp, Homo sapiens
ggccaggaatgggagtgcttaggtgcrgaggtggcactgttcccgcagctgc

SEQ ID NO: 54 - DNA, 51 bp, Homo sapiens
gaaaactccatcccctcagggtcatyagatgaagagaagaccacaggggtt

SEQ ID NO: 55 - DNA, 52 bp, Homo sapiens
tgtaggtaagggtcacatgtgggagasgcagctgtgggtaggtcagccctgt

SEQ ID NO: 56 - DNA, 52 bp, Homo sapiens
  modified_base (27)..(27): May or may not be present
ccaagaaggcgccattacactccagcctgggcgacagggcgagactccctca

SEQ ID NO: 57 - DNA, 52 bp, Homo sapiens
  modified_base (27)..(27): May or may not be present
tgccacacccagctaatttgtgtgtggtatgtgtgtgtatgtatgtgtgtgt

SEQ ID NO: 58 - DNA, 52 bp, Homo sapiens
  modified_base (27)..(27): May or may not be present
gttcctccagtaattttttttttttttggttttgagacagagtcttgccctg

SEQ ID NO: 59 - DNA, 52 bp, Homo sapiens
  modified_base (27)..(27): May or may not be present
atcatgcccagataattttttttttttgtattttagtagacacagggtttca

SEQ ID NO: 60 - DNA, 53 bp, Homo sapiens; identical to SEQ ID NO: 51
  misc_feature (27)..(28): This region may or may not be present in its entirety

SEQ ID NO: 61 - DNA, 52 bp, Homo sapiens
  modified_base (27)..(27): May or may not be present
cctgtgaggggcacattccttagtagctaaggagttgggggtgtgaagatcc

SEQ ID NO: 62 - DNA, 52 bp, Homo sapiens
  modified_base (27)..(27): May or may not be present
acaggctactggctgggcccaggcaaagggggccttggcaggaaaagttcct

SEQ ID NO: 63 - DNA, 53 bp, Homo sapiens
  misc_feature (27)..(28): This region may or may not be present in its entirety
gcgagagagagagagagagagagaggagagccggcgcgagaactacgcatgcg

SEQ ID NO: 64 - DNA, 52 bp, Homo sapiens
aagaagaaaaataaaaagaaagtgggycagaccgagagaacaggaagcctga

SEQ ID NO: 65 - DNA, 52 bp, Homo sapiens
aaggacaaaggcaaagagacaaaggckcaacactgggggtccccagagagtg

SEQ ID NO: 66 - DNA, 52 bp, Homo sapiens
tacctagtcacttcctgcctccatggygcaaaaggggatgggtgtgcctctt

SEQ ID NO: 67 - DNA, 52 bp, Homo sapiens
ctcttccgaggttccaccctgaacacyttcctgctccctcgtggtgtagagt

SEQ ID NO: 68 - DNA, 52 bp, Homo sapiens
ttctgactggcaaccagccccactctytgggagccctcaggaatgaacttgc

SEQ ID NO: 69 - DNA, 52 bp, Homo sapiens
gctcagcctcccaggctggagtgcagwggcgcgatctcggctcaccgcaacc

SEQ ID NO: 70 - DNA, 52 bp, Homo sapiens
catgaaccacatcaaatgagatttagygggagtggcacacacagtcatgacc

SEQ ID NO: 71 - DNA, 52 bp, Homo sapiens
aagcagccctggggagtcggggcgggrcctggattggaaaagagacggtcac

SEQ ID NO: 72 - DNA, 52 bp, Homo sapiens
ctccaagttctgggagcagagtgtgcrgctaggctcctgggatcgagggatg

SEQ ID NO: 73 - DNA, 52 bp, Homo sapiens
  modified_base (27)..(27): May or may not be present
gttcctccagtaatttttttttttttkgttttgagacagagtcttgccctgt

SEQ ID NO: 74 - DNA, 52 bp, Homo sapiens
ctagtaccttacttccctcaagttcawtcatctcacagatatttcctgagca

SEQ ID NO: 75 - DNA, 52 bp, Homo sapiens
aattagccgtgcgtggtggcgggtgcytgtaatcccacgtacttgggaggct

SEQ ID NO: 76 - DNA, 52 bp, Homo sapiens
ccatggccagccggggaggggacgggmacacacagacccacacagagactca

SEQ ID NO: 77 - DNA, 53 bp, Homo sapiens
  modified_base (27)..(27): May or may not be present
agcgagagagagagagagagagagagaggagccggcgcgagaactacgcatgc

SEQ ID NO: 78 - DNA, 52 bp, Homo sapiens
cgtagcagttagcagatgataggcggbgaaatcttatttcacagggcattaa

SEQ ID NO: 79 - DNA, 52 bp, Homo sapiens
ctggccctggtgacagtggggctgtgygtggggccagagccttctcagaggt

SEQ ID NO: 80 - DNA, 52 bp, Homo sapiens
cagatactggccctggtgacagtgggrctgtgcgtggggccagagccttctc

SEQ ID NO: 81 - DNA, 52 bp, Homo sapiens
gacagatactggccctggtgacagtgkggctgtgcgtggggccagagccttc

SEQ ID NO: 82 - DNA, 53 bp, Homo sapiens
  misc_feature (27)..(28): This region may or may not be present in its entirety
ggctcctctctctctctctctctctctcgctcgctctctcgctctctcgctct

SEQ ID NO: 83 - DNA, 52 bp, Homo sapiens
gtttcagaccagcctggccaacatagygaaaccccatctctactaaaaataa

SEQ ID NO: 84 - DNA, 52 bp, Homo sapiens
agtgggcgattggatggagctgagtayggggcccatccaggctaatcacacc

SEQ ID NO: 85 - DNA, 52 bp, Homo sapiens
ccgggctccgtgaatgtttgtcacatstctgaagaacgtatgaattacataa

SEQ ID NO: 86 - DNA, 52 bp, Homo sapiens
gaatcccaaccccgacgctcgtcgccsggctccgtgaatgtttgtcacatgt

SEQ ID NO: 87 - DNA, 52 bp, Homo sapiens
gcgaatcccaaccccgacgctcgtcgycgggctccgtgaatgtttgtcacat

SEQ ID NO: 88 - DNA, 52 bp, Homo sapiens
tgggcagaagtcagggtccaaagaaakggcaaagaaaagtgtcagtggctca

SEQ ID NO: 89 - DNA, 52 bp, Homo sapiens
taagaaagacgtttttgatttttttcrgacttctctggctccactaccctgc

SEQ ID NO: 90 - DNA, 52 bp, Homo sapiens
ctgattcctggccaggagcggtggctyacgcctgtaatcccagcgctttggg

SEQ ID NO: 91 - DNA, 52 bp, Homo sapiens
taaaaatgctgattcctggccaggagyggtggctcacgcctgtaatcccagc

SEQ ID NO: 92 - DNA, 52 bp, Homo sapiens
tttaaaaatgctgattcctggccaggmgcggtggctcacgcctgtaatccca

SEQ ID NO: 93 - DNA, 52 bp, Homo sapiens
caagacctgtcaaagatctgagaaatwttacccgacttacaagctaaccatt

SEQ ID NO: 94 - DNA, 52 bp, Homo sapiens
actgtaataagtgctgtaaaagaaatrcacaaaataatatagcagagggtat

SEQ ID NO: 95 - DNA, 52 bp, Homo sapiens
cttgaggtcaggagttcaagaccagtytgggcaacatggggaaaaccttgtc

SEQ ID NO: 96 - DNA, 52 bp, Homo sapiens
aggttgcagtgagccgagatcatgccrttgcactccagccggggcaacaaaa

SEQ ID NO: 97 - DNA, 52 bp, Homo sapiens
acaagtgtcttgaaattatctgtgatytgctatagagcaatacttttgtaaa

SEQ ID NO: 98 - DNA, 52 bp, Homo sapiens
gtgggtatatgcagctctatgcactayctgctcatttatttggtaaatctaa

SEQ ID NO: 99 - DNA, 59 bp, Homo sapiens
  misc_feature (27)..(34): This region may or may not be present in its entirety
tgtgtgtgtgtgcgtgtgtgtgtgtgtgtgtgtgatcataagagtggctgcagcaaact

SEQ ID NO: 100 - DNA, 52 bp, Homo sapiens
agtctggagtgcaatggtgcaatctcrgctcactgcagcctccacctccggg

SEQ ID NO: 101 - DNA, 52 bp, Homo sapiens
ctcctaatggatatttcctaaattttkctgaacagaatttaacttgagctgg

SEQ ID NO: 102 - DNA, 52 bp, Homo sapiens
atttaaaaatggatttctagaaaaacratcacatacttgaatattttagcaa

SEQ ID NO: 103 - DNA, 52 bp, Homo sapiens
ctataaatgggtagcatgagggattcraggaggtggctgaaagaagcacgta

SEQ ID NO: 104 - DNA, 52 bp, Homo sapiens
aagaaaccaagcatagtagagtgttaraaaaccaaagcaactaaacaactgt

SEQ ID NO: 105 - DNA, 52 bp, Homo sapiens
cggggctcagaacttgtaacagaaaawtaaaatatactccactcaagggaat

SEQ ID NO: 106 - DNA, 57 bp, Homo sapiens
  misc_feature (27)..(32): This region may or may not be present in its entirety
tactacacttcacggatactgtacttgtactttttttccaaattgaaggtttttggc

SEQ ID NO: 107 - DNA, 63 bp, Homo sapiens
  misc_feature (27)..(38): This region may or may not be present in its entirety
ttgtttttgtttttgtttttgtttttgtttttgttttttgagatggagtctcgctctgtcgcc

SEQ ID NO: 108 - DNA, 57 bp, Homo sapiens
  misc_feature (27)..(32): This region may or may not be present in its entirety
tttgccttactacacttcacggatactgtacttgtactttttttccaaattgaaggt

SEQ ID NO: 109 - DNA, 52 bp, Homo sapiens
  modified_base (27)..(27): May or may not be present
gaggtggctgaaagaagcacgtatccctgatggcatggttgcgggttatatg

SEQ ID NO: 110 - DNA, 52 bp, Homo sapiens
  modified_base (27)..(27): May or may not be present
gagaaaagcagttcctggaacacccccaccccttaaccccttatctctgctt

SEQ ID NO: 111 - DNA, 52 bp, Homo sapiens
  modified_base (27)..(27): May or may not be present
ttacatatgtatacatgtgccatgtttggtgtgccgcacccattaactcgtc

SEQ ID NO: 112 - DNA, 52 bp, Homo sapiens
  modified_base (27)..(27): May or may not be present
ctttttccagattttttttttttttttgagacagagtttcactcttgttgcc

SEQ ID NO: 113 - DNA, 52 bp, Homo sapiens
  modified_base (27)..(27): May or may not be present
tttggaaatcttaagcttttatttgggtgtcacagagaaacaggatctgtat

SEQ ID NO: 114 - DNA, 52 bp, Homo sapiens
  modified_base (27)..(27): May or may not be present
tactttaagttttagggtacatgtgcaccatgtgcaggtttgttacatatgt

SEQ ID NO: 115 - DNA, 52 bp, Homo sapiens
  modified_base (27)..(27): May or may not be present
attcatgaccagccacataaatgcacagtattacttcgcaagcatgccaatg

SEQ ID NO: 116 - DNA, 52 bp, Homo sapiens
  modified_base (27)..(27): May or may not be present
gtgcactagaattagctaaagtgggggaaaaaaagatgcatttgatggtcta

SEQ ID NO: 117 - DNA, 52 bp, Homo sapiens
  modified_base (27)..(27): May or may not be present
aacctccacctcccaggttcaagagaattctcctgcctcagcctcccaagta

SEQ ID NO: 118 - DNA, 52 bp, Homo sapiens
cctccctgtgatccgaagtagcagacrtacttaacttccatggtggattgtt

SEQ ID NO: 119 - DNA, 52 bp, Homo sapiens
  modified_base (27)..(27): May or may not be present
aaaacattattatatctagaaaaaaaatgtatcttaaccattgtgggaagtg

SEQ ID NO: 120 - DNA, 52 bp, Homo sapiens
  modified_base (27)..(27): May or may not be present
ttgaaggtaaaatcatagggagttgggagctgtcctcttgcgctgaatcagt

SEQ ID NO: 121 - DNA, 53 bp, Homo sapiens
  misc_feature (27)..(28): This region may or may not be present in its entirety
acttgtggcctttttggagaggttagcaactctgaaaactctgtccctggacc

SEQ ID NO: 122 - DNA, 52 bp, Homo sapiens
  modified_base (27)..(27): May or may not be present
gaaggagaaaaagagaggaaataagttaaaataataaacacaattaataaag

SEQ ID NO: 123 - DNA, 52 bp, Homo sapiens
tgtatacatgtgccatgttggtgtgcygcacccattaactcgtcatttagca

SEQ ID NO: 124 - DNA, 52 bp, Homo sapiens
  modified_base (27)..(27): May or may not be present
tcacctgtcacctcctatagaactttcccctgaccctcctctatagcattaa

SEQ ID NO: 125 - DNA, 52 bp, Homo sapiens
  modified_base (27)..(27): May or may not be present
ataaatgatcatcattcacagtaggggttttgttttgttttttttctggaaa

SEQ ID NO: 126 - DNA, 52 bp, Homo sapiens
  modified_base (27)..(27): May or may not be present
acagacatatctacaaacacactttttcacatatttgtgtaagtcatttatg

SEQ ID NO: 127 - DNA, 52 bp, Homo sapiens
aaagacaactaaactaacgctcaatgmaaaaagtattcgctgctgtttacat

SEQ ID NO: 128 - DNA, 52 bp, Homo sapiens
taccgtgtaccccgtgtttgtgaatgmggccgcatattacgaaaagaaagaa

SEQ ID NO: 129 - DNA, 52 bp, Homo sapiens
cagggctggaggtaaaaccatttattrctaaccccagagcagtgaagaagtg

SEQ ID NO: 130 - DNA, 52 bp, Homo sapiens
ttcttcattgcctattgaagagagagyggaatgctttggttgccagatatgg

SEQ ID NO: 131 - DNA, 52 bp, Homo sapiens
cacaagatctcattactcaggagctgyccaagtgtctaatgtacttagttaa

SEQ ID NO: 132 - DNA, 52 bp, Homo sapiens
ttctgtgtaacatttcatttaagcaarggattcggcaaatcaaaaattgtca

SEQ ID NO: 133 - DNA, 52 bp, Homo sapiens
taaaacgtattgaaggtattattgackctgttgaagcaaagagaacaaaaca

SEQ ID NO: 134 - DNA, 52 bp, Homo sapiens
atctgctcttccagttggatgacaagycttgctgtctaacacctgctgcaga

SEQ ID NO: 135 - DNA, 52 bp, Homo sapiens
ccattttttgttgtattttttttttcytgaatactttttatcgcagttggtt

SEQ ID NO: 136 - DNA, 52 bp, Homo sapiens
ccctgtctctaaaagaaaaaaaaaaaraaaaaaaaaagaaaacaaaacccaa

SEQ ID NO: 137 - DNA, 52 bp, Homo sapiens
agtggctccaaaaaggtcatggaaccycttgaggatgatgcaaattgactct

SEQ ID NO: 138 - DNA, 52 bp, Homo sapiens
taaagttacttttcttttattgacttycccttattttttaaccttatgcttt

SEQ ID NO: 139 - DNA, 52 bp, Homo sapiens
  modified_base (27)..(27): May or may not be present
cagagttaaaaaaaaaaaaaaaaaaaaggaagtagcagcaacagcttggaaa

SEQ ID NO: 140 - DNA, 51 bp, Homo sapiens
gttgcccagggttgagtgcagaggcayatttggctcacagcaacctctgcc

SEQ ID NO: 141 - DNA, 55 bp, Homo sapiens
  misc_feature (27)..(30): This region may or may not be present in its entirety
aaggctttttttttttttttttttttttttgagacagagtcttgctgtgtcaccc

SEQ ID NO: 142 - DNA, 52 bp, Homo sapiens
gcctacattctgcaaagaggagggaasattcacagctccatacttgaaccct

SEQ ID NO: 143 - DNA, 52 bp, Homo sapiens
ccaaaggagaatagctctaggggaggsaggtggatgagtatgcatgggggag

SEQ ID NO: 144 - DNA, 52 bp, Homo sapiens
  modified_base (27)..(27): May or may not be present
gactccatctcaaaaaaaaaaaaaaaatgcagtctaatggcagaattagact

SEQ ID NO: 145 - DNA, 52 bp, Homo sapiens
ttatttatttatttatttatttttgaracagggtctctgttgtccaggctgg

SEQ ID NO: 146 - DNA, 52 bp, Homo sapiens
ttttgaggcagggtctcactctgttgyccagggttgagtgcagaggcacatc

SEQ ID NO: 147 - DNA, 52 bp, Homo sapiens
cgccttgcgaaggccccacagcttgcytgtgacaaacgttcataggcaaatg

SEQ ID NO: 148 - DNA, 52 bp, Homo sapiens
ggaggtctgtacaaagcaccacctacytcatgggtcagtttccacagcagaa

SEQ ID NO: 149 - DNA, 55 bp, Homo sapiens
  misc_feature (27)..(30): This region may or may not be present in its entirety
gaatcttataattcactgtgtacctccctctgtttcatattttcgcaattgaact

SEQ ID NO: 150 - DNA, 52 bp, Homo sapiens
aacatagtatctaatatagctttacayccaaagccaaaatatgaatacactg

SEQ ID NO: 151 - DNA, 52 bp, Homo sapiens
  modified_base (27)..(27): May or may not be present
ttgttttgttttgtttgggggggggggttgtttttctgagagggagtcttgc

SEQ ID NO: 152 - DNA, 53 bp, Homo sapiens
cataccaaagggcagctggagggatacyagacggaagtcatgtggagagtgaa

SEQ ID NO: 153 - DNA, 52 bp, Homo sapiens
caggtgtgagccaccacgaccaccaawttagctctttttactccttcccttc

SEQ ID NO: 154 - DNA, 52 bp, Homo sapiens
agtggtagctgattttgcttctggatmctttgccaccttcccactctttaat

SEQ ID NO: 155 - DNA, 64 bp, Homo sapiens
  misc_feature (27)..(39): This region may or may not be present in its entirety
aaagacctgtttcttaaaaaaaaaaaagaaaaaaaaaaagaaagaaaagaaaagaaaaaaacag

SEQ ID NO: 156 - DNA, 52 bp, Homo sapiens
taaaaaatctttcaatgaggagatgtycccagagcaagacagctgtaggatg

SEQ ID NO: 157 - DNA, 52 bp, Homo sapiens
  modified_base (27)..(27): May or may not be present
aaaagaaaaaaaaaaaaaaaaaaaaaagaaaacaaaacccaaacccataaag

SEQ ID NO: 158 - DNA, 52 bp, Homo sapiens
cctgtctctaaaagaaaaaaaaaaaaraaaaaaaaagaaaacaaaacccaaa

SEQ ID NO: 159 - DNA, 53 bp, Homo sapiens
  misc_feature (27)..(28): This region may or may not be present in its entirety
gttatcatagaaaaatatcacactctgtctgtatccccacttccagaaactgt

SEQ ID NO: 160 - DNA, 52 bp, Homo sapiens
  modified_base (27)..(27): May or may not be present
caggagctcatagaattacatacaatcttttttttttttttttgagacagcg

SEQ ID NO: 161 - DNA, 55 bp, Homo sapiens
  misc_feature (27)..(30): This region may or may not be present in its entirety
ttgagaatcttataattcactgtgtacctccctctgtttcatattttcgcaattg

SEQ ID NO: 162 - DNA, 52 bp, Homo sapiens
ccactaccacagtgcctagagaacaayatgtgtttaataatatttaaataat

SEQ ID NO: 163 - DNA, 52 bp, Homo sapiens
  modified_base (27)..(27): May or may not be present
ccctgtctctaaaagaaaaaaaaaaaaaaaaaaaaaagaaaacaaaacccaa

SEQ ID NO: 164 - DNA, 52 bp, Homo sapiens
  modified_base (27)..(27): May or may not be present
ccattatatcattcatttcccactcattttcttcattccaaccaagatatat

SEQ ID NO: 165 - DNA, 52 bp, Homo sapiens
  modified_base (27)..(27): May or may not be present
tccgtctcaaaaaaaaaaaaaaaaagagaaaggaattattctcatgtataca

SEQ ID NO: 166 - DNA, 52 bp, Homo sapiens
  modified_base (27)..(27): May or may not be present
ctggggcagttaaaaagaaaaacaaacccctggtccctgcccttgaggagat

SEQ ID NO: 167 - DNA, 52 bp, Homo sapiens
  modified_base (27)..(27): May or may not be present
ctccagggtcccattccaggaccacacgcctgctacctctgcagctcactca

SEQ ID NO: 168 - DNA, 52 bp, Homo sapiens
  modified_base (27)..(27): May or may not be present
ggattgacatataccagttagacggattttttttttccataaaccaggctca

SEQ ID NO: 169 - DNA, 52 bp, Homo sapiens
acaaataattactacatatctacaacrttccagatacagaagaaatggccaa

SEQ ID NO: 170 - DNA, 54 bp, Homo sapiens
  misc_feature (27)..(29): This region may or may not be present in its entirety
taaacacacttgaaacatcatataaaatgatattactacaagacttaaccgtaa

SEQ ID NO: 171 - DNA, 52 bp, Homo sapiens
  modified_base (27)..(27): May or may not be present
acacaggtaatccatgtttattatagaaaaatgccacattactctttattga

SEQ ID NO: 172 - DNA, 53 bp, Homo sapiens
  misc_feature (27)..(28): This region may or may not be present in its entirety
agttatcatagaaaaatatcacactctgtctgtatccccacttccagaaactg

SEQ ID NO: 173 - DNA, 52 bp, Homo sapiens
  modified_base (27)..(27): May or may not be present
aatgaacttacaggaaggtaatatatgggaaataaacatcttattgaattta

SEQ ID NO: 174 - DNA, 52 bp, Homo sapiens
  modified_base (27)..(27): May or may not be present
ggacccctgaaaggcacaagacaccctttcaggttcacacttcctgaaagct

SEQ ID NO: 175 - DNA, 52 bp, Homo sapiens
ccaccaatcaccagagccttctgctcrggggtacctgagggaaaacaagcaa

SEQ ID NO: 176 - DNA, 52 bp, Homo sapiens
  modified_base (27)..(27): May or may not be present
aaagactgaaaaaacattcataactatttttcttgttatcctcggaaatgtc

SEQ ID NO: 177 - DNA, 52 bp, Homo sapiens
tatcttcatcttggaggagatgaggtygatttcacctgctggaagtccaacc

SEQ ID NO: 178 - DNA, 52 bp, Homo sapiens
ttgcctatgaacgtttgtcacacttcygctgtgagttgctgaggcgaggtgt

SEQ ID NO: 179 - DNA, 52 bp, Homo sapiens
gcttgctgttggatacatctcgccatyacctgccactctctagcatcctgga

SEQ ID NO: 180 - DNA, 52 bp, Homo sapiens
ccggggcttgctgttggatacatctckccattacctgccactctctagcatc

SEQ ID NO: 181 - DNA, 20 bp, Artificial Sequence
  Description of Artificial Sequence: Synthetic probe
ctccgtttcggtttcacttc

SEQ ID NO: 182 - DNA, 20 bp, Artificial Sequence
  Description of Artificial Sequence: Synthetic probe
atcttctcttcagccctgct

SEQ ID NO: 183 - DNA, 20 bp, Artificial Sequence
  Description of Artificial Sequence: Synthetic primer
gcacgatccgacggtagtgt

SEQ ID NO: 184 - DNA, 20 bp, Artificial Sequence
  Description of Artificial Sequence: Synthetic primer
ccgtaatcgggaagctgaag

SEQ ID NO: 185 - DNA, 70 bp, Artificial Sequence
  Description of Artificial Sequence: Synthetic probe
atggggaaggtgatgaagagtaggcttcagcttcccgatatccgacggtagtgtgggcaggggaccccgg

SEQ ID NO: 186 - DNA, 70 bp, Artificial Sequence
  Description of Artificial Sequence: Synthetic probe
agacgtgcggcaccacgttgagcttcagcttcccgatatccgacggtagtgtgcggacggcggtcgcggg

SEQ ID NO: 187 - DNA, 70 bp, Artificial Sequence
  Description of Artificial Sequence: Synthetic probe
cccccgggccccgcccttcagcttcccgatatccgacggtagtgtggcggccgagtggttctcgctgccg

SEQ ID NO: 188 - DNA, 70 bp, Artificial Sequence
  Description of Artificial Sequence: Synthetic probe
gtccacaaagcagccgttgttgagcttcagcttcccgatatccgacggtagtgtgacgccgagcggtgcg

SEQ ID NO: 189 - DNA, 70 bp, Artificial Sequence
  Description of Artificial Sequence: Synthetic probe
accccctggtccacccggtacttcagcttcccgatatccgacggtagtgtcagcgcctcctcctccctcc

SEQ ID NO: 190 - DNA, 70 bp, Artificial Sequence
  Description of Artificial Sequence: Synthetic probe
ccgagtggttctcgctgcccttcagcttcccgatatccgacggtagtgttctcccgtcccctcctccgcg

SEQ ID NO: 191 - DNA, 70 bp, Artificial Sequence
  Description of Artificial Sequence: Synthetic probe
ggccaggggcatggcgcttcagcttcccgatatccgacggtagtgtctcgctgcgcgcactcaccaatga

SEQ ID NO: 192 - DNA, 70 bp, Artificial Sequence
  Description of Artificial Sequence: Synthetic probe
cgggctgggctcgggcttcagcttcccgatatccgacggtagtgtagaggatggggaaggtgatgaagag

SEQ ID NO: 193 - DNA, 70 bp, Artificial Sequence
  Description of Artificial Sequence: Synthetic probe
tccgctggctccgcgcttcagcttcccgatatccgacggtagtgttaggaagacgtgcggcaccacgttg

SEQ ID NO: 194 - DNA, 70 bp, Artificial Sequence
  Description of Artificial Sequence: Synthetic probe
gcctctgtcccttgcagctcttcagcttcccgatatccgacggtagtgtcgtccacaaagcagccgttgt

SEQ ID NO: 195 - DNA, 70 bp, Artificial Sequence
  Description of Artificial Sequence: Synthetic probe
cccggcccggccgtccttcagcttcccgatatccgacggtagtgttgaggaccccctggtccacccggta

SEQ ID NO: 196 - DNA, 70 bp, Artificial Sequence
  Description of Artificial Sequence: Synthetic probe
aggtatagatggcaaaggcccttcagcttcccgatatccgacggtagtgtcagtttgaggctcccctact

SEQ ID NO: 197 - DNA, 70 bp, Artificial Sequence
  Description of Artificial Sequence: Synthetic probe
gctggtcatctccttcctgcttcagcttcccgatatccgacggtagtgtcggataatctcaaggcctcct

SEQ ID NO: 198 - DNA, 70 bp, Artificial Sequence
  Description of Artificial Sequence: Synthetic probe
tcctgtcctcaccgggaggcttcagcttcccgatatccgacggtagtgtgcttgatgccgcggagcatct

SEQ ID NO: 199 - DNA, 70 bp, Artificial Sequence
  Description of Artificial Sequence: Synthetic probe
cctcccccattgactccacttcagcttcccgatatccgacggtagtgttggtctgcttcagccgctcatt

SEQ ID NO: 200 - DNA, 70 bp, Artificial Sequence
  Description of Artificial Sequence: Synthetic probe
gtctccacccgcgtgccttcagcttcccgatatccgacggtagtgtcttctgtccctgcaccccctctta

SEQ ID NO: 201 - DNA, 70 bp, Artificial Sequence
  Description of Artificial Sequence: Synthetic probe
tctcccaggcgtacagccttcagcttcccgatatccgacggtagtgtcgagctctgacaccctctccttg

SEQ ID NO: 202 - DNA, 70 bp, Artificial Sequence
  Description of Artificial Sequence: Synthetic probe
cttgatgccgcggagcatctccttcagcttcccgatatccgacggtagtgtcgcagcagcacccagggct

SEQ ID NO: 203 - DNA, 70 bp, Artificial Sequence
  Description of Artificial Sequence: Synthetic probe
gtctgcttcagccgctcacttcagcttcccgatatccgacggtagtgttgtgtggggtgaactcactgga

SEQ ID NO: 204 - DNA, 70 bp, Artificial Sequence
  Description of Artificial Sequence: Synthetic probe
actcctgcaggggtccccttcagcttcccgatatccgacggtagtgttggaggtatagatggcaaaggcc

SEQ ID NO: 205 - DNA, 70 bp, Artificial Sequence
  Description of Artificial Sequence: Synthetic probe
aggggagaggcttctgctcttcagcttcccgatatccgacggtagtgtaggctggtcatctccttcctgc

SEQ ID NO: 206 - DNA, 70 bp, Artificial Sequence
  Description of Artificial Sequence: Synthetic probe
ccacccgagaggaaggcctgcttcagcttcccgatatccgacggtagtgtgtctccacccgcgtgcggaa

SEQ ID NO: 207 - DNA, 70 bp, Artificial Sequence
  Description of Artificial Sequence: Synthetic probe
caatactgtcactgccatgcccttcagcttcccgatatccgacggtagtgtctcccaggcgtacagcttc

SEQ ID NO: 208 - DNA, 70 bp, Artificial Sequence
  Description of Artificial Sequence: Synthetic probe
atgaggacagctgcaatggcttcagcttcccgatatccgacggtagtgtctctataaactttcgatccta

SEQ ID NO: 209 - DNA, 70 bp, Artificial Sequence
  Description of Artificial Sequence: Synthetic probe
ccgtgttcatgaaaactgcagcttcagcttcccgatatccgacggtagtgtgtctggctgtggagcctgt

SEQ ID NO: 210 - DNA, 70 bp, Artificial Sequence
  Description of Artificial Sequence: Synthetic probe
agcacagggaggcgtttagtcttcagcttcccgatatccgacggtagtgtgaggcccctgtgcagaaagg

SEQ ID NO: 211 - DNA, 70 bp, Artificial Sequence
  Description of Artificial Sequence: Synthetic probe
gagcgtgacagctacacatggcttcagcttcccgatatccgacggtagtgtctgggcagcctgtcactgc

SEQ ID NO: 212 - DNA, 70 bp, Artificial Sequence
  Description of Artificial Sequence: Synthetic probe
gcccaggatggcttggaggcttcagcttcccgatatccgacggtagtgtgccctccccctccaccctacc

SEQ ID NO: 213 - DNA, 70 bp, Artificial Sequence
  Description of Artificial Sequence: Synthetic probe
agtccagtggggccacttcagcttcccgatatccgacggtagtgtcccaagagatggagaaaggatccac

SEQ ID NO: 214 - DNA, 70 bp, Artificial Sequence
  Description of Artificial Sequence: Synthetic probe
cacagctccagtaggctagggcttcagcttcccgatatccgacggtagtgttgaggacagctgcaatggg

SEQ ID NO: 215 - DNA, 70 bp, Artificial Sequence
  Description of Artificial Sequence: Synthetic probe
tcactagagctttgacggtcttcagcttcccgatatccgacggtagtgtctctgaccaaccaggaccagc

SEQ ID NO: 216 - DNA, 70 bp, Artificial Sequence
  Description of Artificial Sequence: Synthetic probe
gaccacactggacagcagcttcagcttcccgatatccgacggtagtgtagcaaggcccagcaatgggggt

SEQ ID NO: 217 - DNA, 70 bp, Artificial Sequence
  Description of Artificial Sequence: Synthetic probe
aggctcctaagaggatcttcttcagcttcccgatatccgacggtagtgtgcgagaagtcggcctctttga

SEQ ID NO: 218 - DNA, 70 bp, Artificial Sequence
  Description of Artificial Sequence: Synthetic probe
ggtgtgaccaagatatggaagcttcagcttcccgatatccgacggtagtgtcgggaccaaacagctgtgg

SEQ ID NO: 219 - DNA, 70 bp, Artificial Sequence
  Description of Artificial Sequence: Synthetic probe
agagggaggcaaaggccacttcagcttcccgatatccgacggtagtgtggccatcactcgagcaagcctt

SEQ ID NO: 220 - DNA, 70 bp, Artificial Sequence
  Description of Artificial Sequence: Synthetic probe
cgagaagtcggcctctttgacttcagcttcccgatatccgacggtagtgttgacacaggacctgcctgcc

SEQ ID NO: 221 - DNA, 70 bp, Artificial Sequence
  Description of Artificial Sequence: Synthetic probe
ctgacgtggcccacgaaagtctcttcagcttcccgatatccgacggtagtgtctcgcccggaccctcccc

SEQ ID NO: 222 - DNA, 70 bp, Artificial Sequence
  Description of Artificial Sequence: Synthetic probe
gacagaggcacaagtgagcttcagcttcccgatatccgacggtagtgtcctcactagagctttgacggta

SEQ ID NO: 223 - DNA, 70 bp, Artificial Sequence
  Description of Artificial Sequence: Synthetic probe
tggcccagggtgtgggcttcagcttcccgatatccgacggtagtgtatcggaccacactggacagcagga

SEQ ID NO: 224 - DNA, 70 bp, Artificial Sequence
  Description of Artificial Sequence: Synthetic probe
cactggaaacgctcagcacttcagcttcccgatatccgacggtagtgtgcggtgtgaccaagatatggaa

SEQ ID NO: 225 - DNA, 70 bp, Artificial Sequence
  Description of Artificial Sequence: Synthetic probe
ggaaatgagagggctgcttcagcttcccgatatccgacggtagtgtagggagagggaggcaaaggccacg

SEQ ID NO: 226 - DNA, 70 bp, Artificial Sequence
  Description of Artificial Sequence: Synthetic probe
ctggctgggccctgaggcttcagcttcccgatatccgacggtagtgtgacccactgggctgggagctgtg

SEQ ID NO: 227 - DNA, 70 bp, Artificial Sequence
  Description of Artificial Sequence: Synthetic probe
catggggggcacactgctcttcagcttcccgatatccgacggtagtgtggaagggagcccctcttcctgg

SEQ ID NO: 228 - DNA, 70 bp, Artificial Sequence
  Description of Artificial Sequence: Synthetic probe
gatctctgcactggacaggacttcagcttcccgatatccgacggtagtgtaaggcagaagtccgacacag

SEQ ID NO: 229 - DNA, 70 bp, Artificial Sequence
  Description of Artificial Sequence: Synthetic probe
cttagcttttgcacgctgccttcagcttcccgatatccgacggtagtgtcccaagttttgggccttagag

SEQ ID NO: 230 - DNA, 70 bp, Artificial Sequence
  Description of Artificial Sequence: Synthetic probe
agcacagagacacccctcaccttcagcttcccgatatccgacggtagtgttgctgggagtagcaagggga

SEQ ID NO: 231 - DNA, 70 bp, Artificial Sequence
  Description of Artificial Sequence: Synthetic probe
ccaggggcagaggggagggcttcagcttcccgatatccgacggtagtgtgggcactcaccaccgcctggt

SEQ ID NO: 232 - DNA, 70 bp, Artificial Sequence
  Description of Artificial Sequence: Synthetic probe
gcgcagcctgatagagagctccttcagcttcccgatatccgacggtagtgttggctgggccctgaggtgt

SEQ ID NO: 233 - DNA, 70 bp, Artificial Sequence
  Description of Artificial Sequence: Synthetic probe
caggatctcaggcctgaagtatcttcagcttcccgatatccgacggtagtgttggggggcacactgctcc

SEQ ID NO: 234 - DNA, 70 bp, Artificial Sequence
  Description of Artificial Sequence: Synthetic probe
cccacaaagcccacactgaacttcagcttcccgatatccgacggtagtgtgatctctgcactggacagga

SEQ ID NO: 235 - DNA, 70 bp, Artificial Sequence
  Description of Artificial Sequence: Synthetic probe
cgccatctgcactggggaccaggctcttcagcttcccgatatccgacggtagtgtccgtacaggcaggca

SEQ ID NO: 236 - DNA, 70 bp, Artificial Sequence
  Description of Artificial Sequence: Synthetic probe
ctgcagtgggccggtgcttcagcttcccgatatccgacggtagtgtggtgacctctgcagaggactaagc

SEQ ID NO: 237 - DNA, 70 bp, Artificial Sequence
  Description of Artificial Sequence: Synthetic probe
caatcctcccgggctggcttcagcttcccgatatccgacggtagtgtgcagctttctggctttccaggtg

SEQ ID NO: 238 - DNA, 70 bp, Artificial Sequence
  Description of Artificial Sequence: Synthetic probe
ggttcacaaccctgaggggcttcagcttcccgatatccgacggtagtgtgctccctctgggagttggtgc

SEQ ID NO: 239 - DNA, 70 bp, Artificial Sequence
  Description of Artificial Sequence: Synthetic probe
gtggtttggaggtgaggaccccttcagcttcccgatatccgacggtagtgtgccaggcatggggcagcag

SEQ ID NO: 240 - DNA, 70 bp, Artificial Sequence
  Description of Artificial Sequence: Synthetic probe
ggctgggagctgtgtaggcttcagcttcccgatatccgacggtagtgttcacctggacacagcagttgtc

SEQ ID NO: 241 - DNA, 70 bp, Artificial Sequence
  Description of Artificial Sequence: Synthetic probe
gcccctcttcctgggaaaaacttcagcttcccgatatccgacggtagtgtcgccatctgcactggggacc

SEQ ID NO: 242 - DNA, 70 bp, Artificial Sequence
  Description of Artificial Sequence: Synthetic probe
gaagtccgacacagcaggcccttcagcttcccgatatccgacggtagtgtctgcagtgggccggtgaggc

SEQ ID NO: 243 - DNA, 70 bp, Artificial Sequence
  Description of Artificial Sequence: Synthetic probe
tttgggccttagaggaccatgccttcagcttcccgatatccgacggtagtgtatcctcccgggctggacg

SEQ ID NO: 244 - DNA, 70 bp, Artificial Sequence
  Description of Artificial Sequence: Synthetic probe
tcgggggatacgaatggtgcttcagcttcccgatatccgacggtagtgttgtagccttccccttctataa

SEQ ID NO: 245 - DNA, 70 bp, Artificial Sequence
  Description of Artificial Sequence: Synthetic probe
gacagtgtggggattccacttcagcttcccgatatccgacggtagtgtacccagggcatacaccaagaat

SEQ ID NO: 246 - DNA, 70 bp, Artificial Sequence
  Description of Artificial Sequence: Synthetic probe
tccacgtgaagtagcctcttcagcttcccgatatccgacggtagtgtgcagagagtaggtgctcaataaa

SEQ ID NO: 247 - DNA, 70 bp, Artificial Sequence
  Description of Artificial Sequence: Synthetic probe
cttcattaggcgtgtccccttcagcttcccgatatccgacggtagtgtagctttgtctttttatctctat

SEQ ID NO: 248 - DNA, 70 bp, Artificial Sequence
  Description of Artificial Sequence: Synthetic probe
aggagagaacagaaaggcagccttcagcttcccgatatccgacggtagtgtcagtgggacatggggaggg

SEQ ID NO: 249 - DNA, 70 bp, Artificial Sequence
  Description of Artificial Sequence: Synthetic probe
tcccagtgaatagtctctggctcttcagcttcccgatatccgacggtagtgtggaggggtggactgggcc

SEQ ID NO: 250 - DNA, 70 bp, Artificial Sequence
  Description of Artificial Sequence: Synthetic probe
cctcctccatgaaagccacttcagcttcccgatatccgacggtagtgtcctcgggggatacgaatggtga

SEQ ID NO: 251 - DNA, 70 bp, Artificial Sequence
  Description of Artificial Sequence: Synthetic probe
ctgattccagcccctggacttcagcttcccgatatccgacggtagtgttggacagtgtggggattccatc

SEQ ID NO: 252 - DNA, 70 bp, Artificial Sequence
  Description of Artificial Sequence: Synthetic probe
cagagcaggggagtgggacttcagcttcccgatatccgacggtagtgtggtccacgtgaagtagcctccc

SEQ ID NO: 253 - DNA, 70 bp, Artificial Sequence
  Description of Artificial Sequence: Synthetic probe
ccagaagacagcccctgcttcagcttcccgatatccgacggtagtgttgatgatgagaatatccattagc

SEQ ID NO: 254 - DNA, 70 bp, Artificial Sequence
  Description of Artificial Sequence: Synthetic probe
tgcatctcccccagtgcttcagcttcccgatatccgacggtagtgtgcatttattgagtcctcactgaac

SEQ ID NO: 255 - DNA, 70 bp, Artificial Sequence
  Description of Artificial Sequence: Synthetic probe
ggagcgaggacttgccgcttcagcttcccgatatccgacggtagtgtagagtgggccctccaataaatgt

SEQ ID NO: 256 - DNA, 70 bp, Artificial Sequence
  Description of Artificial Sequence: Synthetic probe
ctgccccacgatcatagtcttcagcttcccgatatccgacggtagtgttgcatcctcaactgaggaggat

SEQ ID NO: 257 - DNA, 70 bp, Artificial Sequence
  Description of Artificial Sequence: Synthetic probe
cctgcagggagggaggcttcagcttcccgatatccgacggtagtgtgttaaaaggagatttcccctccac

SEQ ID NO: 258 - DNA, 70 bp, Artificial Sequence
  Description of Artificial Sequence: Synthetic probe
gtgagtggggccgggcttcagcttcccgatatccgacggtagtgttgggccctgaggatacatgtattac

SEQ ID NO: 259 - DNA, 70 bp, Artificial Sequence
  Description of Artificial Sequence: Synthetic probe
caaccattacccagaaagacacttcagcttcccgatatccgacggtagtgtcagaagacagcccctgaga

SEQ ID NO: 260 - DNA, 70 bp, Artificial Sequence
  Description of Artificial Sequence: Synthetic probe
gacagatgcacccaaccctggcttcagcttcccgatatccgacggtagtgtgcatctcccccagtgcggc

SEQ ID NO: 261 - DNA, 70 bp, Artificial Sequence
  Description of Artificial Sequence: Synthetic probe
cctgttttctttcttcctacctcttcagcttcccgatatccgacggtagtgtagcgaggacttgccgcag

SEQ ID NO: 262 - DNA, 70 bp, Artificial Sequence
  Description of Artificial Sequence: Synthetic probe
atccccagcaagtcctctccttcagcttcccgatatccgacggtagtgtcctgccccacgatcatagtca

SEQ ID NO: 263 - DNA, 70 bp, Artificial Sequence
  Description of Artificial Sequence: Synthetic probe
tggggtcctctcctatctcgccttcagcttcccgatatccgacggtagtgtatgcaggccttagccccat

SEQ ID NO: 264 - DNA, 70 bp, Artificial Sequence
  Description of Artificial Sequence: Synthetic probe
aggaaggctgctgggacttcagcttcccgatatccgacggtagtgttctctgaaaatatgtaggctgcac

SEQ ID NO: 265 - DNA, 70 bp, Artificial Sequence
  Description of Artificial Sequence: Synthetic probe
gacagaccaacaccagtcttcagcttcccgatatccgacggtagtgtccctgaatccatactcagcatta

SEQ ID NO: 266 - DNA, 70 bp, Artificial Sequence
  Description of Artificial Sequence: Synthetic probe
accccattgcctttccatcacttcagcttcccgatatccgacggtagtgtccacaagtcctccaccccca

SEQ ID NO: 267 - DNA, 70 bp, Artificial Sequence
  Description of Artificial Sequence: Synthetic probe
agtcttaggggagaagcaacttcagcttcccgatatccgacggtagtgtaccccttccctttgttgagac

SEQ ID NO: 268 - DNA, 70 bp, Artificial Sequence
  Description of Artificial Sequence: Synthetic probe
cctccaaccctcccaccccttcagcttcccgatatccgacggtagtgtcttctgacccagtcccaaggct

SEQ ID NO: 269 - DNA, 70 bp, Artificial Sequence
  Description of Artificial Sequence: Synthetic probe
gggtttccaaatggcctctgcttcagcttcccgatatccgacggtagtgttggggtcctctcctatctcg

SEQ ID NO: 270 - DNA, 70 bp, Artificial Sequence
  Description of Artificial Sequence: Synthetic probe
gtcgctgtctcccgctctgggcttcagcttcccgatatccgacggtagtgtgggccctccctggcctccc

SEQ ID NO: 271 - DNA, 70 bp, Artificial Sequence
  Description of Artificial Sequence: Synthetic probe
agcaggggaggaaaggcatactcttcagcttcccgatatccgacggtagtgttggggctggggtctgggg

SEQ ID NO: 272 - DNA, 70 bp, Artificial Sequence
  Description of Artificial Sequence: Synthetic probe
ctctcatgggagtgaaccatcttcagcttcccgatatccgacggtagtgtccagcagggtgatgtggctc

SEQ ID NO: 273 - DNA, 70 bp, Artificial Sequence
  Description of Artificial Sequence: Synthetic probe
ccaggaagatcctgagctccctcttcagcttcccgatatccgacggtagtgtcctgagagcaccctggag

SEQ ID NO: 274 - DNA, 70 bp, Artificial Sequence
  Description of Artificial Sequence: Synthetic probe
acccaacatgagcatgccttcttcagcttcccgatatccgacggtagtgttgaccctggggggcaatgtt

SEQ ID NO: 275 - DNA, 70 bp, Artificial Sequence
  Description of Artificial Sequence: Synthetic probe
tcccctggacccagtctcttcagcttcccgatatccgacggtagtgtcaggacgcagtacctgatatcca

SEQ ID NO: 276 - DNA, 70 bp, Artificial Sequence
  Description of Artificial Sequence: Synthetic probe
tgaagggactctcaaagatgacttcagcttcccgatatccgacggtagtgtagaggctggagtgcaggta

SEQ ID NO: 277 - DNA, 70 bp, Artificial Sequence
  Description of Artificial Sequence: Synthetic probe
ctcctccacagtggcatttcttcagcttcccgatatccgacggtagtgtcctggggagtgagatggctgg

SEQ ID NO: 278 - DNA, 70 bp, Artificial Sequence
  Description of Artificial Sequence: Synthetic probe
catggtttctgcgaagcataggcttcagcttcccgatatccgacggtagtgttgatcgatggaggggccc

SEQ ID NO: 279 - DNA, 70 bp, Artificial Sequence
  Description of Artificial Sequence: Synthetic probe
cggggcctctcttcctggaaaacttcagcttcccgatatccgacggtagtgtgggcaggctggccagaga

SEQ ID NO: 280 - DNA, 70 bp, Artificial Sequence
  Description of Artificial Sequence: Synthetic probe
agggcgggagtagggggcttcagcttcccgatatccgacggtagtgtgttcctcccctccacatcctgcc

SEQ ID NO: 281 - DNA, 70 bp, Artificial Sequence
  Description of Artificial Sequence: Synthetic probe
gcattctcaggggcttgtcttcagcttcccgatatccgacggtagtgtctccgacaggcttttaccgttg

SEQ ID NO: 282 - DNA, 70 bp, Artificial Sequence
  Description of Artificial Sequence: Synthetic probe
ggcagttgtcaagctgacttcagcttcccgatatccgacggtagtgttgttgaagggactctcaaagatg

SEQ ID NO: 283 - DNA, 70 bp, Artificial Sequence
  Description of Artificial Sequence: Synthetic probe
atggaggcaaggggatgggcttcagcttcccgatatccgacggtagtgttctcctccacagtggcattta

SEQ ID NO: 284 - DNA, 70 bp, Artificial Sequence
  Description of Artificial Sequence: Synthetic probe
cagttggtagaaatctgctcttcagcttcccgatatccgacggtagtgtccatggtttctgcgaagcata

SEQ ID NO: 285 - DNA, 70 bp, Artificial Sequence
  Description of Artificial Sequence: Synthetic probe
atgccctctgcaatctcacttcagcttcccgatatccgacggtagtgtacatagaagacactgagctgct

SEQ ID NO: 286 - DNA, 70 bp, Artificial Sequence
  Description of Artificial Sequence: Synthetic probe
ggacgaagagcagcatgacttcagcttcccgatatccgacggtagtgttgtagtaacaaaagacatgggc

SEQ ID NO: 287 - DNA, 70 bp, Artificial Sequence
  Description of Artificial Sequence: Synthetic probe
gatccccaaggctggtacaccttcagcttcccgatatccgacggtagtgttgtgcaccttggagctctga

SEQ ID NO: 288 - DNA, 70 bp, Artificial Sequence
  Description of Artificial Sequence: Synthetic probe
gatccaccgcaggttgtcttcagcttcccgatatccgacggtagtgtgtggaatataggtgagctaggat

SEQ ID NO: 289 - DNA, 70 bp, Artificial Sequence
  Description of Artificial Sequence: Synthetic probe
aaatgaagccatgtgctgtgcttcagcttcccgatatccgacggtagtgttgggcctttcaggaagtacc

SEQ ID NO: 290 - DNA, 70 bp, Artificial Sequence
  Description of Artificial Sequence: Synthetic probe
tgtgcaccttggagctccttcagcttcccgatatccgacggtagtgtggagcagattcactttcctgagt

SEQ ID NO: 291 - DNA, 70 bp, Artificial Sequence
  Description of Artificial Sequence: Synthetic probe
ccatcctgcagggagagacttcagcttcccgatatccgacggtagtgtcagacagtcactcacccatcag

SEQ ID NO: 292 - DNA, 70 bp, Artificial Sequence
  Description of Artificial Sequence: Synthetic probe
aggcaggatgcctgccccttcagcttcccgatatccgacggtagtgtaggatgccctctgcaatctcaca

SEQ ID NO: 293 - DNA, 70 bp, Artificial Sequence
  Description of Artificial Sequence: Synthetic probe
gaggaagagggtgcatgacttcagcttcccgatatccgacggtagtgtcaggacgaagagcagcatgaag

SEQ ID NO: 294 - DNA, 70 bp, Artificial Sequence
  Description of Artificial Sequence: Synthetic probe
aaaggtgcttgggcattgggcttcagcttcccgatatccgacggtagtgtgatccaccgcaggttgtgcc

SEQ ID NO: 295 - DNA, 70 bp, Artificial Sequence
  Description of Artificial Sequence: Synthetic probe
ggtgagggtgacacctaccttcagcttcccgatatccgacggtagtgtggaaatgaagccatgtgctgtg

SEQ ID NO: 296 - DNA, 70 bp, Artificial Sequence
  Description of Artificial Sequence: Synthetic probe
ttccccaatctgggtctggtctcttcagcttcccgatatccgacggtagtgtacaacatgtttgacctta

SEQ ID NO: 297 - DNA, 70 bp, Artificial Sequence
  Description of Artificial Sequence: Synthetic probe
tggggcaggatgtcgatcttcagcttcccgatatccgacggtagtgtgcaggcaactcttcagccttcaa

SEQ ID NO: 298 - DNA, 70 bp, Artificial Sequence
  Description of Artificial Sequence: Synthetic probe
gcagagagcaggcttcacttcagcttcccgatatccgacggtagtgttctcctatttcctagttacccat

SEQ ID NO: 299 - DNA, 70 bp, Artificial Sequence
  Description of Artificial Sequence: Synthetic probe
cttgtacctggcgtgggtcttcagcttcccgatatccgacggtagtgtcctgagtagtgtctcagggcat

SEQ ID NO: 300 - DNA, 70 bp, Artificial Sequence
  Description of Artificial Sequence: Synthetic probe
ggggatgcagctggtcagccttcagcttcccgatatccgacggtagtgtggttgggggtcctggctttga

SEQ ID NO: 301 - DNA, 70 bp, Artificial Sequence
  Description of Artificial Sequence: Synthetic probe
agagttggcccgagcactcttcagcttcccgatatccgacggtagtgtaacccctcagaggctgctacta

SEQ ID NO: 302 - DNA, 70 bp, Artificial Sequence
  Description of Artificial Sequence: Synthetic probe
ggtcattagtctctgggtagccttcagcttcccgatatccgacggtagtgttccccaatctgggtctggt

SEQ ID NO: 303 - DNA, 70 bp, Artificial Sequence
  Description of Artificial Sequence: Synthetic probe
cccagggtgagcaatggccttcagcttcccgatatccgacggtagtgtcatggggcaggatgtcgatgtc

SEQ ID NO: 304 - DNA, 70 bp, Artificial Sequence
  Description of Artificial Sequence: Synthetic probe
ggcctcccgcttgggtcttcagcttcccgatatccgacggtagtgtggctgcagagagcaggcttcaatg

SEQ ID NO: 305 - DNA, 70 bp, Artificial Sequence
  Description of Artificial Sequence: Synthetic probe
aagaagacaacgttggcgtcttcagcttcccgatatccgacggtagtgtctaggatgataaggcaatatc

SEQ ID NO: 306 - DNA, 70 bp, Artificial Sequence
  Description of Artificial Sequence: Synthetic probe
agagggctcgggccaccttcagcttcccgatatccgacggtagtgtctggcaggagggatttactcctgg

SEQ ID NO: 307 - DNA, 70 bp, Artificial Sequence
  Description of Artificial Sequence: Synthetic probe
ctggcgttgaccaccagcttcagcttcccgatatccgacggtagtgtagggagattgttggatgatggtg

SEQ ID NO: 308 - DNA, 70 bp, Artificial Sequence
  Description of Artificial Sequence: Synthetic probe
atgccctgtcaccaaagaggagcttcagcttcccgatatccgacggtagtgtggggaggtggaggtgggc

SEQ ID NO: 309 - DNA, 70 bp, Artificial Sequence
  Description of Artificial Sequence: Synthetic probe
cacatcatgccctcagccattcttcagcttcccgatatccgacggtagtgtgcctgggaggcagccagag

SEQ ID NO: 310 - DNA, 70 bp, Artificial Sequence
  Description of Artificial Sequence: Synthetic probe
agacactgtcctgtaccctactgcttcagcttcccgatatccgacggtagtgtcccaagggaacttgcac

SEQ ID NO: 311 - DNA, 70 bp, Artificial Sequence
  Description of Artificial Sequence: Synthetic probe
ctatgagctctttgggatggacttcagcttcccgatatccgacggtagtgtagaagacaacgttggcgtg

SEQ ID NO: 312 - DNA, 70 bp, Artificial Sequence
  Description of Artificial Sequence: Synthetic probe
tggctctatccacttctttgcccttcagcttcccgatatccgacggtagtgtagggctcgggccacactg

SEQ ID NO: 313 - DNA, 70 bp, Artificial Sequence
  Description of Artificial Sequence: Synthetic probe
ttctcaccttgcatagagaaggcttcagcttcccgatatccgacggtagtgtggcgttgaccaccagaca

SEQ ID NO: 314 - DNA, 70 bp, Artificial Sequence
  Description of Artificial Sequence: Synthetic probe
cagtctgcatggggcaggtcttcagcttcccgatatccgacggtagtgtcccagcatgcataaagccatc

SEQ ID NO: 315 - DNA, 70 bp, Artificial Sequence
  Description of Artificial Sequence: Synthetic probe
gcttgtgggtcactaagacttcagcttcccgatatccgacggtagtgttgctggtctcttatgctttgtg

SEQ ID NO: 316 - DNA, 70 bp, Artificial Sequence
  Description of Artificial Sequence: Synthetic probe
ctagttagctgtgtggccttcagcttcccgatatccgacggtagtgtggtcactcagatggatatccaga

SEQ ID NO: 317 - DNA, 70 bp, Artificial Sequence
  Description of Artificial Sequence: Synthetic probe
cctcttgtcgtcccggacttcagcttcccgatatccgacggtagtgtcctcagcagttgctaccaagaca

SEQ ID NO: 318 - DNA, 70 bp, Artificial Sequence
  Description of Artificial Sequence: Synthetic probe
aggatgccggcctgcacttcagcttcccgatatccgacggtagtgtcggattggttcctgccaagatgcc

SEQ ID NO: 319 - DNA, 70 bp, Artificial Sequence
  Description of Artificial Sequence: Synthetic probe
cactcagatggatatccagagctgcttcagcttcccgatatccgacggtagtgtccccagccctgccccc

SEQ ID NO: 320 - DNA, 70 bp, Artificial Sequence
  Description of Artificial Sequence: Synthetic probe
gaaggggtcatcctgggcagcttcagcttcccgatatccgacggtagtgtcctgacccccttgttccccc

SEQ ID NO: 321 - DNA, 70 bp, Artificial Sequence
  Description of Artificial Sequence: Synthetic probe
agaggaagagagtagagggtcttcagcttcccgatatccgacggtagtgtcagtctgcatggggcaggta

SEQ ID NO: 322 - DNA, 70 bp, Artificial Sequence
  Description of Artificial Sequence: Synthetic probe
aaggcatggtggggaggcttcagcttcccgatatccgacggtagtgtgtagcttgtgggtcactaagacc

SEQ ID NO: 323 - DNA, 70 bp, Artificial Sequence
  Description of Artificial Sequence: Synthetic probe
tgagtataaaacccattagagttctcttcagcttcccgatatccgacggtagtgttgtcgtcccggagca

SEQ ID NO: 324 - DNA, 70 bp, Artificial Sequence
  Description of Artificial Sequence: Synthetic probe
atcaactctgctctagggactcttcagcttcccgatatccgacggtagtgtggatgccggcctgcattaa

SEQ ID NO: 325 - DNA, 70 bp, Artificial Sequence
  Description of Artificial Sequence: Synthetic probe
tccagctcttggtcctgtcgcttcagcttcccgatatccgacggtagtgttaggagccagttcatgccca

SEQ ID NO: 326 - DNA, 70 bp, Artificial Sequence
  Description of Artificial Sequence: Synthetic probe
tgagggtcttccagtgctcacttcagcttcccgatatccgacggtagtgtcacatctgccctttaggggg

SEQ ID NO: 327 - DNA, 70 bp, Artificial Sequence
  Description of Artificial Sequence: Synthetic probe
tccactgcaagtgggctgcttcagcttcccgatatccgacggtagtgtggtgccatccttcatggcaatg

SEQ ID NO: 328 - DNA, 70 bp, Artificial Sequence
  Description of Artificial Sequence: Synthetic probe
ctggcattcagacctctggacttcagcttcccgatatccgacggtagtgttggggcactaaggacaggaa

SEQ ID NO: 329 - DNA, 70 bp, Artificial Sequence
  Description of Artificial Sequence: Synthetic probe
ttgagggtaccctccctctggatggcttcagcttcccgatatccgacggtagtgtagttcaggttctagc

SEQ ID NO: 330 - DNA, 70 bp, Artificial Sequence
  Description of Artificial Sequence: Synthetic probe
tgccatccttcatggcaatgacttcagcttcccgatatccgacggtagtgttttgcatccaggggtggct

SEQ ID NO: 331 - DNA, 70 bp, Artificial Sequence
  Description of Artificial Sequence: Synthetic probe
gaaaggcagcaacaaacttcagcttcccgatatccgacggtagtgtcttggccatccctggatataccca

SEQ ID NO: 332 - DNA, 70 bp, Artificial Sequence
  Description of Artificial Sequence: Synthetic probe
ggggctggctggggagcttcagcttcccgatatccgacggtagtgtcttctccagctcttggtcctgtcg

SEQ ID NO: 333 - DNA, 70 bp, Artificial Sequence
  Description of Artificial Sequence: Synthetic probe
tcacatccctcaattgtggacttcagcttcccgatatccgacggtagtgttgagggtcttccagtgctca

SEQ ID NO: 334 - DNA, 70 bp, Artificial Sequence
  Description of Artificial Sequence: Synthetic probe
agatggaggttgacacatccccttcagcttcccgatatccgacggtagtgttggcattcagacctctgga

SEQ ID NO: 335 - DNA, 70 bp, Artificial Sequence
  Description of Artificial Sequence: Synthetic probe
ctcactacaaatggccaccagcttcagcttcccgatatccgacggtagtgttgagggtaccctccctctg

SEQ ID NO: 336 - DNA, 70 bp, Artificial Sequence
  Description of Artificial Sequence: Synthetic probe
ctcctcttcctcatcctgcagcttcagcttcccgatatccgacggtagtgtactgaggggacaacggggg

SEQ ID NO: 337 - DNA, 70 bp, Artificial Sequence
  Description of Artificial Sequence: Synthetic probe
ccatccctcgaggacacttcagcttcccgatatccgacggtagtgtacacagagggaagccatttaatca

SEQ ID NO: 338 - DNA, 70 bp, Artificial Sequence
  Description of Artificial Sequence: Synthetic probe
ataggccctggggtggctcttcagcttcccgatatccgacggtagtgtgcacactactgcaccacaccca

SEQ ID NO: 339 - DNA, 70 bp, Artificial Sequence
  Description of Artificial Sequence: Synthetic probe
ttttctctctgtgacagtccttcagcttcccgatatccgacggtagtgtcccaaaccttagcctctctgt

SEQ ID NO: 340 - DNA, 70 bp, Artificial Sequence
  Description of Artificial Sequence: Synthetic probe
aagacagatgtggcctggcttcagcttcccgatatccgacggtagtgttgatcagacctcaggccataat

SEQ ID NO: 341 - DNA, 70 bp, Artificial Sequence
  Description of Artificial Sequence: Synthetic probe
cttcaggatatatggttggtgcttcagcttcccgatatccgacggtagtgtcccagtcccattgcctgta

SEQ ID NO: 342 - DNA, 70 bp, Artificial Sequence
  Description of Artificial Sequence: Synthetic probe
aaggggaagttaaggggtcttcagcttcccgatatccgacggtagtgttcctcctcttcctcatcctgca

SEQ ID NO: 343 - DNA, 70 bp, Artificial Sequence
  Description of Artificial Sequence: Synthetic probe
ctggtgatgaccaatgtcagcttcagcttcccgatatccgacggtagtgtccatccctcgaggacatggc

SEQ ID NO: 344 - DNA, 70 bp, Artificial Sequence
  Description of Artificial Sequence: Synthetic probe
tactttgtccctgcctgagggcttcagcttcccgatatccgacggtagtgttaggccctggggtggctct

SEQ ID NO: 345 - DNA, 70 bp, Artificial Sequence
  Description of Artificial Sequence: Synthetic probe
gcaggggtcagggtcagcttcagcttcccgatatccgacggtagtgtgcatagacagtctggtcgagggt

SEQ ID NO: 346 - DNA, 70 bp, Artificial Sequence
  Description of Artificial Sequence: Synthetic probe
cggtccacttggccagccttcagcttcccgatatccgacggtagtgtactccttcacaggcagagagtga

SEQ ID NO: 347 - DNA, 70 bp, Artificial Sequence
  Description of Artificial Sequence: Synthetic probe
catttccatccctctgagggtgacttcagcttcccgatatccgacggtagtgtggagcaggatgccggcg

SEQ ID NO: 348 - DNA, 70 bp, Artificial Sequence
  Description of Artificial Sequence: Synthetic probe
cagggcattttatccccacttcttcagcttcccgatatccgacggtagtgtaggtacttggcgcaggctc

SEQ ID NO: 349 - DNA, 70 bp, Artificial Sequence
  Description of Artificial Sequence: Synthetic probe
aggggacaacgggggcacttcagcttcccgatatccgacggtagtgtcatgggatctcagcacgctggtg

SEQ ID NO: 350 - DNA, 70 bp, Artificial Sequence
  Description of Artificial Sequence: Synthetic probe
gaagccatttaatcaaaggcacactcttcagcttcccgatatccgacggtagtgtgacaggttgtcatcc

SEQ ID NO: 351 - DNA, 70 bp, Artificial Sequence
  Description of Artificial Sequence: Synthetic probe
gatggccaccaggaccatgtcttcagcttcccgatatccgacggtagtgtagttccagggtgcccatggg

SEQ ID NO: 352 - DNA, 70 bp, Artificial Sequence
  Description of Artificial Sequence: Synthetic probe
agcagctgtgagaagaccacttcagcttcccgatatccgacggtagtgtgcccttcccccatccccactc

SEQ ID NO: 353 - DNA, 70 bp, Artificial Sequence
  Description of Artificial Sequence: Synthetic probe
acaggagcaggatgccggccttcagcttcccgatatccgacggtagtgtcctctgccatgggccgccagt

SEQ ID NO: 354 - DNA, 70 bp, Artificial Sequence
  Description of Artificial Sequence: Synthetic probe
caggtacttggcgcaggctcttcagcttcccgatatccgacggtagtgtcctggctgagggagcagttcc

SEQ ID NO: 355 - DNA, 70 bp, Artificial Sequence
  Description of Artificial Sequence: Synthetic probe
gggatctcagcacgctggtgcttcagcttcccgatatccgacggtagtgtgcaggggtcagggtcagggc

SEQ ID NO: 356 - DNA, 70 bp, Artificial Sequence
  Description of Artificial Sequence: Synthetic probe
tggacgacaggttgtcatcctcttcagcttcccgatatccgacggtagtgtggtccacttggccagccag

SEQ ID NO: 357 - DNA, 70 bp, Artificial Sequence
  Description of Artificial Sequence: Synthetic probe
gctctcagctgcctcctctcttcagcttcccgatatccgacggtagtgtcgatggccaccaggaccatgt

SEQ ID NO: 358 - DNA, 70 bp, Artificial Sequence
  Description of Artificial Sequence: Synthetic probe
cgcaagaacccactctgtcttcagcttcccgatatccgacggtagtgttgagcagctgtgagaagaccag

SEQ ID NO: 359 - DNA, 70 bp, Artificial Sequence
  Description of Artificial Sequence: Synthetic probe
aggatgatccggtttagccttcagcttcccgatatccgacggtagtgtacttttacacacactgtctcct

SEQ ID NO: 360 - DNA, 70 bp, Artificial Sequence
  Description of Artificial Sequence: Synthetic probe
ggtgcagtctcttggccaccttcagcttcccgatatccgacggtagtgttcacccccacaagcttgtgac

SEQ ID NO: 361 - DNA, 70 bp, Artificial Sequence
  Description of Artificial Sequence: Synthetic probe
acacctggctgagggagccttcagcttcccgatatccgacggtagtgtcaggctgcagagcaccgtgaac

SEQ ID NO: 362 - DNA, 70 bp, Artificial Sequence
  Description of Artificial Sequence: Synthetic probe
ggctgcaggggtcaggcttcagcttcccgatatccgacggtagtgtccatggcatagacagtctggtcga

SEQ ID NO: 363 - DNA, 70 bp, Artificial Sequence
  Description of Artificial Sequence: Synthetic probe
ccctgtccactccacacttcagcttcccgatatccgacggtagtgtggttgtatatccccattttataga

SEQ ID NO: 364 - DNA, 70 bp, Artificial Sequence
  Description of Artificial Sequence: Synthetic probe
gtgacgaggcacagcacttcagcttcccgatatccgacggtagtgtgggaagactaaggctcagagaaca

SEQ ID NO: 365 - DNA, 70 bp, Artificial Sequence
  Description of Artificial Sequence: Synthetic probe
ggctgcagagcaccgtgcttcagcttcccgatatccgacggtagtgtgacttgctcacagtcccagcctg

SEQ ID NO: 366 - DNA, 70 bp, Artificial Sequence
  Description of Artificial Sequence: Synthetic probe
ggcatagacagtctggtcgacttcagcttcccgatatccgacggtagtgtgggagacgggtacctcatgg

SEQ ID NO: 367 - DNA, 70 bp, Artificial Sequence
  Description of Artificial Sequence: Synthetic probe
cactccttcacaggcagagacttcagcttcccgatatccgacggtagtgtaggatgatccggtttagcag

SEQ ID NO: 368 - DNA, 70 bp, Artificial Sequence
  Description of Artificial Sequence: Synthetic probe
ttggagttccagggtgccccttcagcttcccgatatccgacggtagtgtcggtgcagtctcttggccacc

SEQ ID NO: 369 - DNA, 70 bp, Artificial Sequence
  Description of Artificial Sequence: Synthetic probe
tcagcccttcccccatcccttcagcttcccgatatccgacggtagtgtagccctgtccactccacagtga

SEQ ID NO: 370 - DNA, 70 bp, Artificial Sequence
  Description of Artificial Sequence: Synthetic probe
caacctctgccatgggcccttcagcttcccgatatccgacggtagtgtacgtgacgaggcacagcacaat

SEQ ID NO: 371 - DNA, 70 bp, Artificial Sequence
  Description of Artificial Sequence: Synthetic probe
tggtcgatggtgttacagtcttcagcttcccgatatccgacggtagtgtgaagcagcattataatcggat

SEQ ID NO: 372 - DNA, 70 bp, Artificial Sequence
  Description of Artificial Sequence: Synthetic probe
aaaatctgttcaggatgctcccttcagcttcccgatatccgacggtagtgtcactggcttcttcccagag

SEQ ID NO: 373 - DNA, 70 bp, Artificial Sequence
  Description of Artificial Sequence: Synthetic probe
gggcgtggtctcaaaaaacttcagcttcccgatatccgacggtagtgttgtgatcacctgatctggggaa

SEQ ID NO: 374 - DNA, 70 bp, Artificial Sequence
  Description of Artificial Sequence: Synthetic probe
ggcagccagaggaagagttcttcagcttcccgatatccgacggtagtgtgcctcagacaggagaagcccc

SEQ ID NO: 375 - DNA, 70 bp, Artificial Sequence
  Description of Artificial Sequence: Synthetic probe
ttgtccattgatttacttcctgcttcagcttcccgatatccgacggtagtgtccgaggtgtctctggaag

SEQ ID NO: 376 - DNA, 70 bp, Artificial Sequence
  Description of Artificial Sequence: Synthetic probe
actgaatgagatagttaattatttcttcagcttcccgatatccgacggtagtgttgtggcacggtcctct

SEQ ID NO: 377 - DNA, 70 bp, Artificial Sequence
  Description of Artificial Sequence: Synthetic probe
atgtaagtgtctctggagtccttcagcttcccgatatccgacggtagtgttggtcgatggtgttacagtc

SEQ ID NO: 378 - DNA, 70 bp, Artificial Sequence
  Description of Artificial Sequence: Synthetic probe
tgggtctggcatcctctgcttcagcttcccgatatccgacggtagtgttgaaaatctgttcaggatgctc

SEQ ID NO: 379 - DNA, 70 bp, Artificial Sequence
  Description of Artificial Sequence: Synthetic probe
tggacgccacccggaagtacttcagcttcccgatatccgacggtagtgttgtggatatttctatttcctt

SEQ ID NO: 380 - DNA, 70 bp, Artificial Sequence
  Description of Artificial Sequence: Synthetic probe
gatgaagtagcacacgacttcagcttcccgatatccgacggtagtgttttctgttttttgtttttatttt

SEQ ID NO: 381 - DNA, 70 bp, Artificial Sequence
  Description of Artificial Sequence: Synthetic probe
tttgatcctttatttttttgagacttcagcttcccgatatccgacggtagtgttgagacacagagcaggg

SEQ ID NO: 382 - DNA, 70 bp, Artificial Sequence
  Description of Artificial Sequence: Synthetic probe
gagtctcactgttgcccagaccttcagcttcccgatatccgacggtagtgtggctcaggcactccagcgt

SEQ ID NO: 383 - DNA, 70 bp, Artificial Sequence
  Description of Artificial Sequence: Synthetic probe
ggcaagagggccacgacttcagcttcccgatatccgacggtagtgttggagggaacacgaccctattact

SEQ ID NO: 384 - DNA, 70 bp, Artificial Sequence
  Description of Artificial Sequence: Synthetic probe
gtgtgacataggagatgacggcttcagcttcccgatatccgacggtagtgtacgatgagtctagcaagta

SEQ ID NO: 385 - DNA, 70 bp, Artificial Sequence
  Description of Artificial Sequence: Synthetic probe
ggctgagacacagagcacttcagcttcccgatatccgacggtagtgtccaaactgcacattgcaaagcac

SEQ ID NO: 386 - DNA, 70 bp, Artificial Sequence
  Description of Artificial Sequence: Synthetic probe
cggctcaggcactccagcgcttcagcttcccgatatccgacggtagtgtcacccctcacccctgaggcca

SEQ ID NO: 387 - DNA, 70 bp, Artificial Sequence
  Description of Artificial Sequence: Synthetic probe
ggatgtgctgagggagacgacttcagcttcccgatatccgacggtagtgttggacgccacccggaagtac

SEQ ID NO: 388 - DNA, 70 bp, Artificial Sequence
  Description of Artificial Sequence: Synthetic probe
agagagtgaggtgaattttggtcttcagcttcccgatatccgacggtagtgttgaagtagcacacgatgg

SEQ ID NO: 389 - DNA, 70 bp, Artificial Sequence
  Description of Artificial Sequence: Synthetic probe
gactgtgtttagagtgctactcttcagcttcccgatatccgacggtagtgtgcaagagggccacgaggaa

SEQ ID NO: 390 - DNA, 70 bp, Artificial Sequence
  Description of Artificial Sequence: Synthetic probe
gccatgttttgctctcactcttcagcttcccgatatccgacggtagtgtggtgtgacataggagatgacg

SEQ ID NO: 391 - DNA, 70 bp, Artificial Sequence
  Description of Artificial Sequence: Synthetic probe
tggtggtgagtccttctacggcttcagcttcccgatatccgacggtagtgtttgggacctgaggcagctt

SEQ ID NO: 392 - DNA, 70 bp, Artificial Sequence
  Description of Artificial Sequence: Synthetic probe
ggcaaagtgtgagagaagtggcttcagcttcccgatatccgacggtagtgtgaacgtgtccttggccttc

SEQ ID NO: 393 - DNA, 70 bp, Artificial Sequence
  Description of Artificial Sequence: Synthetic probe
tgggtggtgtcatccagccttcagcttcccgatatccgacggtagtgtagtggagtcctgagaatcaaat

SEQ ID NO: 394 - DNA, 70 bp, Artificial Sequence
  Description of Artificial Sequence: Synthetic probe
ggtccctgtggcggggaacagagcttcagcttcccgatatccgacggtagtgtctgtgccccctggcccc

SEQ ID NO: 395 - DNA, 70 bp, Artificial Sequence
  Description of Artificial Sequence: Synthetic probe
gaacagttaagagggcaggccttcagcttcccgatatccgacggtagtgttgttccactcctaccttggg

SEQ ID NO: 396 - DNA, 70 bp, Artificial Sequence
  Description of Artificial Sequence: Synthetic probe
gctcggcctgggcctcttcagcttcccgatatccgacggtagtgtggaatgtggactcgtacctgaaggc

SEQ ID NO: 397 - DNA, 70 bp, Artificial Sequence
  Description of Artificial Sequence: Synthetic probe
tccacctgctaccgctgcttcagcttcccgatatccgacggtagtgtggatggtggtgagtccttctacg

SEQ ID NO: 398 - DNA, 70 bp, Artificial Sequence
  Description of Artificial Sequence: Synthetic probe
aatggccttacctctctaggcttcagcttcccgatatccgacggtagtgtggcaaagtgtgagagaagtg

SEQ ID NO: 399 - DNA, 70 bp, Artificial Sequence
  Description of Artificial Sequence: Synthetic probe
gcttcttaccccgtgaagggcttcagcttcccgatatccgacggtagtgttgggtggtgtcatccagctg

SEQ ID NO: 400 - DNA, 70 bp, Artificial Sequence
  Description of Artificial Sequence: Synthetic probe
tggggaagttggaagtccttcagcttcccgatatccgacggtagtgtccatgaaggcagggatttttttc

SEQ ID NO: 401 - DNA, 70 bp, Artificial Sequence
  Description of Artificial Sequence: Synthetic probe
gtgatagtagaccacggagcttcagcttcccgatatccgacggtagtgttctattccaaatctctactgt

SEQ ID NO: 402 - DNA, 70 bp, Artificial Sequence
  Description of Artificial Sequence: Synthetic probe
gcagccatgaacgccatcttcagcttcccgatatccgacggtagtgtagagcaatagctggcacataatg

SEQ ID NO: 403 - DNA, 70 bp, Artificial Sequence
  Description of Artificial Sequence: Synthetic probe
gcatgtacaggtgcacttcagcttcccgatatccgacggtagtgtagtcctcagtaaacattatctgaag

SEQ ID NO: 404 - DNA, 70 bp, Artificial Sequence
  Description of Artificial Sequence: Synthetic probe
ttcggtcaccctgagatggcttcagcttcccgatatccgacggtagtgtgaatgaaggtactgcccctcc

SEQ ID NO: 405 - DNA, 70 bp, Artificial Sequence
  Description of Artificial Sequence: Synthetic probe
gaaacagacaggatggggaccttcagcttcccgatatccgacggtagtgtacacctcacctaccaattag

SEQ ID NO: 406 - DNA, 70 bp, Artificial Sequence
  Description of Artificial Sequence: Synthetic probe
aagtactgcaatagagcagcccttcagcttcccgatatccgacggtagtgtggggaagttggaagtctcg

SEQ ID NO: 407 - DNA, 70 bp, Artificial Sequence
  Description of Artificial Sequence: Synthetic probe
ccttgaatttcaaaggctgaacttcagcttcccgatatccgacggtagtgttgatagtagaccacggagg

SEQ ID NO: 408 - DNA, 70 bp, Artificial Sequence
  Description of Artificial Sequence: Synthetic probe
gaacctttatagcatcactttatagcttcagcttcccgatatccgacggtagtgtcatgaacgccatccc

SEQ ID NO: 409 - DNA, 70 bp, Artificial Sequence
  Description of Artificial Sequence: Synthetic probe
gctgcagggccctttagtcttcagcttcccgatatccgacggtagtgttggcatgtacaggtgcagatgg

SEQ ID NO: 410 - DNA, 70 bp, Artificial Sequence
  Description of Artificial Sequence: Synthetic probe
attcggacttccagccatctgtcttcagcttcccgatatccgacggtagtgtaggaccaccagggctggg

SEQ ID NO: 411 - DNA, 70 bp, Artificial Sequence
  Description of Artificial Sequence: Synthetic probe
cagctgtgaggaagagggacttcagcttcccgatatccgacggtagtgtgcaggaaggcttggtgtccac

SEQ ID NO: 412 - DNA, 70 bp, Artificial Sequence
  Description of Artificial Sequence: Synthetic probe
gttgttggagtctgtgtcttcagcttcccgatatccgacggtagtgtgatctggtatcctatcctctctt

SEQ ID NO: 413 - DNA, 70 bp, Artificial Sequence
  Description of Artificial Sequence: Synthetic probe
agcttctgctggaaccgggcttcagcttcccgatatccgacggtagtgtccccaggtacctgtgtgctct

SEQ ID NO: 414 - DNA, 70 bp, Artificial Sequence
  Description of Artificial Sequence: Synthetic probe
acctggagggaggatgagaacttcagcttcccgatatccgacggtagtgttggccccaccctcctatcag

SEQ ID NO: 415 - DNA, 70 bp, Artificial Sequence
  Description of Artificial Sequence: Synthetic probe
taagggaacagtgttggtcccttcagcttcccgatatccgacggtagtgtagggtagaggggaatagcac

SEQ ID NO: 416 - DNA, 70 bp, Artificial Sequence
  Description of Artificial Sequence: Synthetic probe
gctcctaggagtctccctcttcagcttcccgatatccgacggtagtgtccattcggacttccagccatct

SEQ ID NO: 417 - DNA, 70 bp, Artificial Sequence
  Description of Artificial Sequence: Synthetic probe
gagggaggctccagggccttcagcttcccgatatccgacggtagtgttggcagctgtgaggaagagggaa

SEQ ID NO: 418 - DNA, 70 bp, Artificial Sequence
  Description of Artificial Sequence: Synthetic probe
tccccagacatgccacccttcagcttcccgatatccgacggtagtgtaatgttgttggagtctgtgtatt

SEQ ID NO: 419 - DNA, 70 bp, Artificial Sequence
  Description of Artificial Sequence: Synthetic probe
ttcatgtaagctatccctctctggcttcagcttcccgatatccgacggtagtgttctgctggaaccgggc

SEQ ID NO: 420 - DNA, 70 bp, Artificial Sequence
  Description of Artificial Sequence: Synthetic probe
gcccaccaggccagcacttcagcttcccgatatccgacggtagtgtctgtccctctggcatcagatgcaa

SEQ ID NO: 421 - DNA, 70 bp, Artificial Sequence
  Description of Artificial Sequence: Synthetic probe
ctgtgcagggagttggagatgcttcagcttcccgatatccgacggtagtgtttggggtaaggcctgggag

SEQ ID NO: 422 - DNA, 70 bp, Artificial Sequence
  Description of Artificial Sequence: Synthetic probe
tcaccgctgcgatgagccttcagcttcccgatatccgacggtagtgttctcatgtctccagtgacgaagg

SEQ ID NO: 423 - DNA, 70 bp, Artificial Sequence
  Description of Artificial Sequence: Synthetic probe
tgcaccgatgtactcctgggcttcagcttcccgatatccgacggtagtgtcgggagtgctggtgtctgac

SEQ ID NO: 424 - DNA, 70 bp, Artificial Sequence
  Description of Artificial Sequence: Synthetic probe
agaggagctgacctgggcgcttcagcttcccgatatccgacggtagtgtcctctgccctagcccactgcc

SEQ ID NO: 425 - DNA, 70 bp, Artificial Sequence
  Description of Artificial Sequence: Synthetic probe
ggttagagccacaggccccttcagcttcccgatatccgacggtagtgtcaccattagggcgtaggtaagg

SEQ ID NO: 426 - DNA, 70 bp, Artificial Sequence
  Description of Artificial Sequence: Synthetic probe
acctcactccttttcggggccttcagcttcccgatatccgacggtagtgtgcccaccaggccagcagaga

SEQ ID NO: 427 - DNA, 70 bp, Artificial Sequence
  Description of Artificial Sequence: Synthetic probe
gcagctcagccaggcctccacttcagcttcccgatatccgacggtagtgtctgtgcagggagttggagat

SEQ ID NO: 428 - DNA, 70 bp, Artificial Sequence
  Description of Artificial Sequence: Synthetic probe
gccctgcaactcatgcacaccttcagcttcccgatatccgacggtagtgttcaccgctgcgatgagcacc

SEQ ID NO: 429 - DNA, 70 bp, Artificial Sequence
  Description of Artificial Sequence: Synthetic probe
ccctcgtagctctctgcctcggtcttcagcttcccgatatccgacggtagtgtccgggctgggctcagcc

SEQ ID NO: 430 - DNA, 70 bp, Artificial Sequence
  Description of Artificial Sequence: Synthetic probe
tcaggagcccatggatgcgcttcagcttcccgatatccgacggtagtgtggcatgggccacagctagtat

SEQ ID NO: 431 - DNA, 70 bp, Artificial Sequence
  Description of Artificial Sequence: Synthetic probe
agcccccagctggagctcttcagcttcccgatatccgacggtagtgtgaaagtgccaccccatccccagg

SEQ ID NO: 432 - DNA, 70 bp, Artificial Sequence
  Description of Artificial Sequence: Synthetic probe
gccaggttcctcaccatccacttcagcttcccgatatccgacggtagtgtttgtggcccccaacccagac

SEQ ID NO: 433 - DNA, 70 bp, Artificial Sequence
  Description of Artificial Sequence: Synthetic probe
ggtagttggagacctgtgggcttcagcttcccgatatccgacggtagtgtcctccttggactcttcccca

SEQ ID NO: 434 - DNA, 70 bp, Artificial Sequence
  Description of Artificial Sequence: Synthetic probe
agccagtggcgcacactccttcagcttcccgatatccgacggtagtgtctctccctgagcctctcaccca

SEQ ID NO: 435 - DNA, 70 bp, Artificial Sequence
  Description of Artificial Sequence: Synthetic probe
gcttagttctgtcctcagcccttcagcttcccgatatccgacggtagtgtccctcgtagctctctgcctc

SEQ ID NO: 436 - DNA, 70 bp, Artificial Sequence
  Description of Artificial Sequence: Synthetic probe
aatggctcttcttaaggctggacttcagcttcccgatatccgacggtagtgtaggagcccatggatgcgc

SEQ ID NO: 437 - DNA, 70 bp, Artificial Sequence
  Description of Artificial Sequence: Synthetic probe
gggccagggccccagattccttcagcttcccgatatccgacggtagtgtcagcccccagctggagctcca

SEQ ID NO: 438 - DNA, 70 bp, Artificial Sequence
  Description of Artificial Sequence: Synthetic probe
ctgccatccactgcctgccttcagcttcccgatatccgacggtagtgtctgccaggttcctcaccatcca

SEQ ID NO: 439 - DNA, 70 bp, Artificial Sequence
  Description of Artificial Sequence: Synthetic probe
gatgagggcattgacgtgccttcagcttcccgatatccgacggtagtgtagactgcgatgtctgaatagt

SEQ ID NO: 440 - DNA, 70 bp, Artificial Sequence
  Description of Artificial Sequence: Synthetic probe
accggcttcagggagctgtcgtacttcagcttcccgatatccgacggtagtgttcggccctggagggcca

SEQ ID NO: 441 - DNA, 70 bp, Artificial Sequence
  Description of Artificial Sequence: Synthetic probe
gcacgctcaggttctggatcttcagcttcccgatatccgacggtagtgtgtgactgcgaagccatccagc

SEQ ID NO: 442 - DNA, 70 bp, Artificial Sequence
  Description of Artificial Sequence: Synthetic probe
cttcccttggtctggccagtcttcagcttcccgatatccgacggtagtgtgcatgccccatcccctgctc

SEQ ID NO: 443 - DNA, 70 bp, Artificial Sequence
  Description of Artificial Sequence: Synthetic probe
gggatcagcgatggtgctcttcagcttcccgatatccgacggtagtgtcctgtcctgcagcattgggttg

SEQ ID NO: 444 - DNA, 70 bp, Artificial Sequence
  Description of Artificial Sequence: Synthetic probe
gggctgggctcagccaccttcagcttcccgatatccgacggtagtgtcccgtgctctgaccttctgtcca

SEQ ID NO: 445 - DNA, 70 bp, Artificial Sequence
  Description of Artificial Sequence: Synthetic probe
ggccacagctagtatccgaacttcagcttcccgatatccgacggtagtgtgatgagggcattgacgtgct

SEQ ID NO: 446 - DNA, 70 bp, Artificial Sequence
  Description of Artificial Sequence: Synthetic probe
caccccatccccaggctccttcagcttcccgatatccgacggtagtgtgcaccggcttcagggagctgtc

SEQ ID NO: 447 - DNA, 70 bp, Artificial Sequence
  Description of Artificial Sequence: Synthetic probe
gcccccaacccagacacactcttcagcttcccgatatccgacggtagtgtgcacgctcaggttctggatc

SEQ ID NO: 448 - DNA, 70 bp, Artificial Sequence
  Description of Artificial Sequence: Synthetic probe
ttggactcttccccacccccttcagcttcccgatatccgacggtagtgttcttcccttggtctggccagt

SEQ ID NO: 449 - DNA, 70 bp, Artificial Sequence
  Description of Artificial Sequence: Synthetic probe
acgtgtccaccatgcggacttcagcttcccgatatccgacggtagtgtatgatgatgtgccctgcatggg

SEQ ID NO: 450 - DNA, 70 bp, Artificial Sequence
  Description of Artificial Sequence: Synthetic probe
aagagagaaggaggacttcccacttcagcttcccgatatccgacggtagtgtgagggtgcaggggaaggc

SEQ ID NO: 451 - DNA, 70 bp, Artificial Sequence
  Description of Artificial Sequence: Synthetic probe
ccggtgcggccgcagatcttcagcttcccgatatccgacggtagtgttgactgctgggcctcctgtcatg

SEQ ID NO: 452 - DNA, 70 bp, Artificial Sequence
  Description of Artificial Sequence: Synthetic probe
ggaaagagagaagcagcttcagcttcccgatatccgacggtagtgtctgaccacgtgccagggctgaggc

SEQ ID NO: 453 - DNA, 70 bp, Artificial Sequence
  Description of Artificial Sequence: Synthetic probe
ctgggactctggggctgccttcagcttcccgatatccgacggtagtgtatctggtggctgtgggtacacg

SEQ ID NO: 454 - DNA, 70 bp, Artificial Sequence
  Description of Artificial Sequence: Synthetic probe
agcctctatgctagctctgggcttcagcttcccgatatccgacggtagtgtgcccgccttacaactcacc

SEQ ID NO: 455 - DNA, 70 bp, Artificial Sequence
  Description of Artificial Sequence: Synthetic probe
tgtgcaggtgtgggaggtcttcagcttcccgatatccgacggtagtgtgaacgtgtccaccatgcggaag

SEQ ID NO: 456 - DNA, 70 bp, Artificial Sequence
  Description of Artificial Sequence: Synthetic probe
tatctttttggcctggttcttcagcttcccgatatccgacggtagtgtgcaagagagaaggaggacttcc

SEQ ID NO: 457 - DNA, 70 bp, Artificial Sequence
  Description of Artificial Sequence: Synthetic probe
tagtttctctttggacaccacagcttcagcttcccgatatccgacggtagtgtgtgcggccgcagatccc

SEQ ID NO: 458 - DNA, 70 bp, Artificial Sequence
  Description of Artificial Sequence: Synthetic probe
ggatggtgccgctgaagaggcttcagcttcccgatatccgacggtagtgtctgcctgggcctgatgggat

SEQ ID NO: 459 - DNA, 70 bp, Artificial Sequence
  Description of Artificial Sequence: Synthetic probe
gtcctgcaggatgatggagacttcagcttcccgatatccgacggtagtgtagggcatgagcaggaaacac

SEQ ID NO: 460 - DNA, 70 bp, Artificial Sequence
  Description of Artificial Sequence: Synthetic probe
gagcgcagggtgtgcagcttcagcttcccgatatccgacggtagtgtctgggatcctggtctcccccaac

SEQ ID NO: 461 - DNA, 70 bp, Artificial Sequence
  Description of Artificial Sequence: Synthetic probe
tggcgatgtcaatgccacttcagcttcccgatatccgacggtagtgtcctcctctttgtgctccagatct

SEQ ID NO: 462 - DNA, 70 bp, Artificial Sequence
  Description of Artificial Sequence: Synthetic probe
gatgtgccctgcatgggtccttcagcttcccgatatccgacggtagtgtgaactgagccggcctggggct

SEQ ID NO: 463 - DNA, 70 bp, Artificial Sequence
  Description of Artificial Sequence: Synthetic probe
agggtgcaggggaaggcggtgcttcagcttcccgatatccgacggtagtgtgcctgaggggtggtggggc

SEQ ID NO: 464 - DNA, 70 bp, Artificial Sequence
  Description of Artificial Sequence: Synthetic probe
ctgggcctcctgtcatgtctcttcagcttcccgatatccgacggtagtgtggatggtgccgctgaagagg

SEQ ID NO: 465 - DNA, 70 bp, Artificial Sequence
  Description of Artificial Sequence: Synthetic probe
cgtgccagggctgaggccttcagcttcccgatatccgacggtagtgtggggtcctgcaggatgatggaga

SEQ ID NO: 466 - DNA, 70 bp, Artificial Sequence
  Description of Artificial Sequence: Synthetic probe
gtggctgtgggtacacgtggcttcagcttcccgatatccgacggtagtgtgagcgcagggtgtgcagcgg

SEQ ID NO: 467 - DNA, 70 bp, Artificial Sequence
  Description of Artificial Sequence: Synthetic probe
ccgccttacaactcaccttccttcagcttcccgatatccgacggtagtgttggcgatgtcaatgccatca

SEQ ID NO: 468 - DNA, 70 bp, Artificial Sequence
  Description of Artificial Sequence: Synthetic probe
ccttcaccaccagcttcacttcagcttcccgatatccgacggtagtgtaagtaggactaaatggtcctgc

SEQ ID NO: 469 - DNA, 70 bp, Artificial Sequence
  Description of Artificial Sequence: Synthetic probe
gatttccagggcctcccacttcagcttcccgatatccgacggtagtgtgcttcagactccaaacttgggg

SEQ ID NO: 470 - DNA, 70 bp, Artificial Sequence
  Description of Artificial Sequence: Synthetic probe
ctatctgagcacttcctctcacttcagcttcccgatatccgacggtagtgttgagacacgggcttctgtc

SEQ ID NO: 471 - DNA, 70 bp, Artificial Sequence
  Description of Artificial Sequence: Synthetic probe
ccaggttaaatctggaagtggcttcagcttcccgatatccgacggtagtgtccttacagggtccttgagt

SEQ ID NO: 472 - DNA, 70 bp, Artificial Sequence
  Description of Artificial Sequence: Synthetic probe
gaaagccccagtagggagggcttcagcttcccgatatccgacggtagtgtaccaacccagctgcatagcc

SEQ ID NO: 473 - DNA, 70 bp, Artificial Sequence
  Description of Artificial Sequence: Synthetic probe
ggtcctgcctgcatcccttcagcttcccgatatccgacggtagtgtggagtagttaccgaggcctcctgg

SEQ ID NO: 474 - DNA, 70 bp, Artificial Sequence
  Description of Artificial Sequence: Synthetic probe
aaagagggcagtgagcgagcttcagcttcccgatatccgacggtagtgtgccttcaccaccagcttcagc

SEQ ID NO: 475 - DNA, 70 bp, Artificial Sequence
  Description of Artificial Sequence: Synthetic probe
ctgagttggaggtctggctgcttcagcttcccgatatccgacggtagtgtgatttccagggcctcccaca

SEQ ID NO: 476 - DNA, 70 bp, Artificial Sequence
  Description of Artificial Sequence: Synthetic probe
agcaccgaggtggtggcttcagcttcccgatatccgacggtagtgttgtgctatctgagcacttcctctc

SEQ ID NO: 477 - DNA, 70 bp, Artificial Sequence
  Description of Artificial Sequence: Synthetic probe
gtggcctcgtccatgacttcagcttcccgatatccgacggtagtgtcattttctgcaacacatagcattt

SEQ ID NO: 478 - DNA, 70 bp, Artificial Sequence
  Description of Artificial Sequence: Synthetic probe
tggtcttcctcacgaaggccttcagcttcccgatatccgacggtagtgtttagaggcaacttgagcctca

SEQ ID NO: 479 - DNA, 70 bp, Artificial Sequence
  Description of Artificial Sequence: Synthetic probe
caggcagaacagctgcccttcagcttcccgatatccgacggtagtgtactacttcgtgcaaatttctccc

SEQ ID NO: 480 - DNA, 70 bp, Artificial Sequence
  Description of Artificial Sequence: Synthetic probe
tggctgaaattctccccttcagcttcccgatatccgacggtagtgtagcatcccactaaaccctttccaa

SEQ ID NO: 481 - DNA, 70 bp, Artificial Sequence
  Description of Artificial Sequence: Synthetic probe
tgatgatggcatctgaaaacagccttcagcttcccgatatccgacggtagtgttcccatggaggggccca

SEQ ID NO: 482 - DNA, 70 bp, Artificial Sequence
  Description of Artificial Sequence: Synthetic probe
ggggagatgaagtaggactgacttcagcttcccgatatccgacggtagtgtaccgtggccatgtcaatgg

SEQ ID NO: 483 - DNA, 70 bp, Artificial Sequence
  Description of Artificial Sequence: Synthetic probe
atcttgtgctgtgagtggacttcagcttcccgatatccgacggtagtgtcgtggcctcgtccatgatgaa

SEQ ID NO: 484 - DNA, 70 bp, Artificial Sequence
  Description of Artificial Sequence: Synthetic probe
gggatggcttggggggccttcagcttcccgatatccgacggtagtgttgctggtcttcctcacgaaggcc

SEQ ID NO: 485 - DNA, 70 bp, Artificial Sequence
  Description of Artificial Sequence: Synthetic probe
aatgtgtgcatgggggcaaacttcagcttcccgatatccgacggtagtgtcaggcagaacagctgcctct

SEQ ID NO: 486 - DNA, 70 bp, Artificial Sequence
  Description of Artificial Sequence: Synthetic probe
gggtgtgtgtccaagagcaccttcagcttcccgatatccgacggtagtgttggctgaaattctccccgcc

SEQ ID NO: 487 - DNA, 70 bp, Artificial Sequence
  Description of Artificial Sequence: Synthetic probe
gcgatggtgaccacagtgccttcagcttcccgatatccgacggtagtgtctccaggccccttgccctgaa

SEQ ID NO: 488 - DNA, 70 bp, Artificial Sequence
  Description of Artificial Sequence: Synthetic probe
cgaaggctgtcatcacccttcagcttcccgatatccgacggtagtgtgcctgcttcagggttctttcttg

SEQ ID NO: 489 - DNA, 70 bp, Artificial Sequence
  Description of Artificial Sequence: Synthetic probe
gaggatgttttcctgccaagtgcttcagcttcccgatatccgacggtagtgtggaccaggcaagcccagg

SEQ ID NO: 490 - DNA, 70 bp, Artificial Sequence
  Description of Artificial Sequence: Synthetic probe
gcaacagctgttggctcaccttcagcttcccgatatccgacggtagtgtgtgcactgatgacggccacaa

SEQ ID NO: 491 - DNA, 70 bp, Artificial Sequence
  Description of Artificial Sequence: Synthetic probe
agtggatggggtctggcctcttcagcttcccgatatccgacggtagtgtccagtcctgtccctgggtgtc

SEQ ID NO: 492 - DNA, 70 bp, Artificial Sequence
  Description of Artificial Sequence: Synthetic probe
ggggatgtggagcccaggtccttcagcttcccgatatccgacggtagtgtgcaccccatcaatgggcccc

SEQ ID NO: 493 - DNA, 70 bp, Artificial Sequence
  Description of Artificial Sequence: Synthetic probe
ctcagctcccatctgacccccttcagcttcccgatatccgacggtagtgtgcgatggtgaccacagtgcg

SEQ ID NO: 494 - DNA, 70 bp, Artificial Sequence
  Description of Artificial Sequence: Synthetic probe
tagtcccacccccacccccttcagcttcccgatatccgacggtagtgttgcgaaggctgtcatcaccacc

SEQ ID NO: 495 - DNA, 70 bp, Artificial Sequence
  Description of Artificial Sequence: Synthetic probe
aggaggcgaagacgctgtccttcagcttcccgatatccgacggtagtgttgcccaccagacttagggcct

SEQ ID NO: 496 - DNA, 70 bp, Artificial Sequence
  Description of Artificial Sequence: Synthetic probe
gctgagcagcttctctgcttcagcttcccgatatccgacggtagtgtagtaggaaataatcaaatctatt

SEQ ID NO: 497 - DNA, 70 bp, Artificial Sequence
  Description of Artificial Sequence: Synthetic probe
aactcaaggatggcaccccttcagcttcccgatatccgacggtagtgtttacaagtgatttacagttaga

SEQ ID NO: 498 - DNA, 70 bp, Artificial Sequence
  Description of Artificial Sequence: Synthetic probe
ggacgatcaccaggtctgcacttcagcttcccgatatccgacggtagtgtcaggcaggggtatgggcagg

SEQ ID NO: 499 - DNA, 70 bp, Artificial Sequence
  Description of Artificial Sequence: Synthetic probe
gatggtgtgcactcgatgccttcagcttcccgatatccgacggtagtgtgaatgtgggatggcacttggg

SEQ ID NO: 500 - DNA, 70 bp, Artificial Sequence
  Description of Artificial Sequence: Synthetic probe
gggcaggagggggcgcttcagcttcccgatatccgacggtagtgtctctggcaggtcacttgtctgcacg

SEQ ID NO: 501 - DNA, 70 bp, Artificial Sequence
  Description of Artificial Sequence: Synthetic probe
gtgggaataccacccgcggcttcagcttcccgatatccgacggtagtgtaaggaggcgaagacgctgtcc

SEQ ID NO: 502 - DNA, 70 bp, Artificial Sequence
  Description of Artificial Sequence: Synthetic probe
ccacagctgagggtggcccttcagcttcccgatatccgacggtagtgtcggctgagcagcttctctggct

SEQ ID NO: 503 - DNA, 70 bp, Artificial Sequence
  Description of Artificial Sequence: Synthetic probe
ggcttggaggaggaggatgacttcagcttcccgatatccgacggtagtgtaactcaaggatggcaccccg

SEQ ID NO: 504 - DNA, 70 bp, Artificial Sequence
  Description of Artificial Sequence: Synthetic probe
gtggccagaatgtcctgtcacttcagcttcccgatatccgacggtagtgtggacgatcaccaggtctgca

SEQ ID NO: 505 - DNA, 70 bp, Artificial Sequence
  Description of Artificial Sequence: Synthetic probe
ctgatgacattgacctccacgcttcagcttcccgatatccgacggtagtgtcactcccctttacacgggc

SEQ ID NO: 506 - DNA, 70 bp, Artificial Sequence
  Description of Artificial Sequence: Synthetic probe
gcagcatcccatagaggatcttcagcttcccgatatccgacggtagtgtaaaacaagctgatcccttctc

SEQ ID NO: 507 - DNA, 70 bp, Artificial Sequence
  Description of Artificial Sequence: Synthetic probe
acagaataagcgtgcctgggtgtgcttcagcttcccgatatccgacggtagtgtcttgacaaacttgatg

SEQ ID NO: 508 - DNA, 70 bp, Artificial Sequence
  Description of Artificial Sequence: Synthetic probe
acatttccgagtaagtggatgtcttcagcttcccgatatccgacggtagtgttgatgaaggccagggtcc

SEQ ID NO: 509 - DNA, 70 bp, Artificial Sequence
  Description of Artificial Sequence: Synthetic probe
cagccctgtgaggcagaagccttcagcttcccgatatccgacggtagtgtggctgagaagcagggtgggg

SEQ ID NO: 510 - DNA, 70 bp, Artificial Sequence
  Description of Artificial Sequence: Synthetic probe
tgcgagaagccgatggcgcttcagcttcccgatatccgacggtagtgttgaacccagggcaggacagagg

SEQ ID NO: 511 - DNA, 70 bp, Artificial Sequence
  Description of Artificial Sequence: Synthetic probe
agaacttgacaaacttgatggtcttcagcttcccgatatccgacggtagtgtctctgcttcccaccccac

SEQ ID NO: 512 - DNA, 70 bp, Artificial Sequence
  Description of Artificial Sequence: Synthetic probe
ggtgatgaaggccagggtccaataccttcagcttcccgatatccgacggtagtgtgtggcctgcttaccc

SEQ ID NO: 513 - DNA, 70 bp, Artificial Sequence
  Description of Artificial Sequence: Synthetic probe
accagcagggctgccgcttcagcttcccgatatccgacggtagtgtcaccctgatgacattgacctccac

SEQ ID NO: 514 - DNA, 70 bp, Artificial Sequence
  Description of Artificial Sequence: Synthetic probe
ggaagatcgcagagacgtgcttcagcttcccgatatccgacggtagtgtagcagcatcccatagaggatc

SEQ ID NO: 515 - DNA, 70 bp, Artificial Sequence
  Description of Artificial Sequence: Synthetic probe
tcatgtgtgtacactcacatcttcagcttcccgatatccgacggtagtgtcagccctgtgaggcagaagc

SEQ ID NO: 516 - DNA, 70 bp, Artificial Sequence
  Description of Artificial Sequence: Synthetic probe
gtgcaagtatgtggcagagaacttcagcttcccgatatccgacggtagtgtgcgagaagccgatggcgtg

SEQ ID NO: 517 - DNA, 70 bp, Artificial Sequence
  Description of Artificial Sequence: Synthetic probe
ggcgtcaaaggcctcgcttcagcttcccgatatccgacggtagtgttgtgacttaaggcaagcttcttcc

SEQ ID NO: 518 - DNA, 70 bp, Artificial Sequence
  Description of Artificial Sequence: Synthetic probe
tggtagttggtgagggccccttcagcttcccgatatccgacggtagtgtaccagcctcagtttcccctct

SEQ ID NO: 519 - DNA, 70 bp, Artificial Sequence
  Description of Artificial Sequence: Synthetic probe
gggccatgggggatggcttcagcttcccgatatccgacggtagtgtggcagtcttgatgaaggcgttcat

SEQ ID NO: 520 - DNA, 70 bp, Artificial Sequence
  Description of Artificial Sequence: Synthetic probe
acttctcaccactccctacccttcagcttcccgatatccgacggtagtgtagtaggtgcctttggacagc

SEQ ID NO: 521 - DNA, 70 bp, Artificial Sequence
  Description of Artificial Sequence: Synthetic probe
ccagcaaggatctggggttgcttcagcttcccgatatccgacggtagtgtcacgaagggctgcaggaagc

SEQ ID NO: 522 - DNA, 70 bp, Artificial Sequence
  Description of Artificial Sequence: Synthetic probe
ttccacacttgatctctaacacttcagcttcccgatatccgacggtagtgtccaggtcttgcaggtcctc

SEQ ID NO: 523 - DNA, 70 bp, Artificial Sequence
  Description of Artificial Sequence: Synthetic probe
gggccatctttcgcctgtcttcagcttcccgatatccgacggtagtgtaggcttcacctccctcggtgtc

SEQ ID NO: 524 - DNA, 70 bp, Artificial Sequence
  Description of Artificial Sequence: Synthetic probe
cgatgggcagcttcccgatggctcttcagcttcccgatatccgacggtagtgtcaggattttgacctaat

SEQ ID NO: 525 - DNA, 70 bp, Artificial Sequence
  Description of Artificial Sequence: Synthetic probe
caagtcgatgggcttcttgtcttcagcttcccgatatccgacggtagtgtttgaggtccctctctgtgac

SEQ ID NO: 526 - DNA, 70 bp, Artificial Sequence
  Description of Artificial Sequence: Synthetic probe
gtcttgatgaaggcgttcacttcagcttcccgatatccgacggtagtgtaaccagaaggcagtgaataga

SEQ ID NO: 527 - DNA, 70 bp, Artificial Sequence
  Description of Artificial Sequence: Synthetic probe
agtaggtgcctttggaccttcagcttcccgatatccgacggtagtgtgtgtggctgtgcccccactgacc

SEQ ID NO: 528 - DNA, 70 bp, Artificial Sequence
  Description of Artificial Sequence: Synthetic probe
cacgaagggctgcaggaagccttcagcttcccgatatccgacggtagtgtggcgtcaaaggcctcgcaga

SEQ ID NO: 529 - DNA, 70 bp, Artificial Sequence
  Description of Artificial Sequence: Synthetic probe
cccaggtcttgcaggtcctcttcagcttcccgatatccgacggtagtgtttggtagttggtgagggccct

SEQ ID NO: 530 - DNA, 70 bp, Artificial Sequence
  Description of Artificial Sequence: Synthetic probe
gcttcacctccctcggtgtccttcagcttcccgatatccgacggtagtgtcgatgggcagcttcccgatg

SEQ ID NO: 531 - DNA, 70 bp, Artificial Sequence
  Description of Artificial Sequence: Synthetic probe
gaagatgtatctctgtggggccttcagcttcccgatatccgacggtagtgtaagtcgatgggcttcttgt

SEQ ID NO: 532 - DNA, 70 bp, Artificial Sequence
  Description of Artificial Sequence: Synthetic probe
ttgggctggaagacgtcgtcttcagcttcccgatatccgacggtagtgtttctgtggtggggatactgct

SEQ ID NO: 533 - DNA, 70 bp, Artificial Sequence
  Description of Artificial Sequence: Synthetic probe
tcccaaggtggtccacgacttcagcttcccgatatccgacggtagtgtggctttgcgcatgtgtgaggag

SEQ ID NO: 534 - DNA, 70 bp, Artificial Sequence
  Description of Artificial Sequence: Synthetic probe
ctcccaggatgcccctagctccttcagcttcccgatatccgacggtagtgtgctgctgaggaccaggcgc

SEQ ID NO: 535 - DNA, 70 bp, Artificial Sequence
  Description of Artificial Sequence: Synthetic probe
tgtctggggaaacccagtcttcagcttcccgatatccgacggtagtgtccgaaggcatggctgagtgcct

SEQ ID NO: 536 - DNA, 70 bp, Artificial Sequence
  Description of Artificial Sequence: Synthetic probe
tcctctgcaaataggtgaactcccttcagcttcccgatatccgacggtagtgtgcccgggcaccttgagt

SEQ ID NO: 537 - DNA, 70 bp, Artificial Sequence
  Description of Artificial Sequence: Synthetic probe
gatgcacagtggcccggcttcagcttcccgatatccgacggtagtgtactccagtgtggccatggctcac

SEQ ID NO: 538 - DNA, 70 bp, Artificial Sequence
  Description of Artificial Sequence: Synthetic probe
agcaggtcggccaagatgcttcagcttcccgatatccgacggtagtgtcattggcctgttgcactctcag

SEQ ID NO: 539 - DNA, 70 bp, Artificial Sequence
  Description of Artificial Sequence: Synthetic probe
tgctgctgaggaccaggcttcagcttcccgatatccgacggtagtgtacaactgaaaaccatctagaggg

SEQ ID NO: 540 - DNA, 70 bp, Artificial Sequence
  Description of Artificial Sequence: Synthetic probe
gaaggcatggctgagtgcccttcagcttcccgatatccgacggtagtgtttaccctacccctggggctgc

SEQ ID NO: 541 - DNA, 70 bp, Artificial Sequence
  Description of Artificial Sequence: Synthetic probe
atggcccgggcaccttcttcagcttcccgatatccgacggtagtgttaccttgggctggaagacgtcgtt

SEQ ID NO: 542 - DNA, 70 bp, Artificial Sequence
  Description of Artificial Sequence: Synthetic probe
gaatgtccttccgctgccccttcagcttcccgatatccgacggtagtgtttcccaaggtggtccacgatc

SEQ ID NO: 543 - DNA, 70 bp, Artificial Sequence
  Description of Artificial Sequence: Synthetic probe
accatggccaggtcagagtgcttcagcttcccgatatccgacggtagtgtgatgcacagtggcccggcga

SEQ ID NO: 544 - DNA, 70 bp, Artificial Sequence
  Description of Artificial Sequence: Synthetic probe
gggctaattcacggctgggcctcttcagcttcccgatatccgacggtagtgtcaggtcggccaagatgcg

SEQ ID NO: 545 - DNA, 70 bp, Artificial Sequence
  Description of Artificial Sequence: Synthetic probe
tcaagttaattccagtttcaacttcagcttcccgatatccgacggtagtgtacatcgttaatgggcaaca

SEQ ID NO: 546 - DNA, 70 bp, Artificial Sequence
  Description of Artificial Sequence: Synthetic probe
cacatagtaggatgcttgccttcagcttcccgatatccgacggtagtgtataaatttacagcagaattat

SEQ ID NO: 547 - DNA, 70 bp, Artificial Sequence
  Description of Artificial Sequence: Synthetic probe
caagaccctctgggcttgcttcagcttcccgatatccgacggtagtgtgcattggcaaggaactcttggg

SEQ ID NO: 548 - DNA, 70 bp, Artificial Sequence
  Description of Artificial Sequence: Synthetic probe
ttgtgcaattgtttatgagtcttcagcttcccgatatccgacggtagtgtacaaagtaaaccccgagaaa

SEQ ID NO: 549 - DNA, 70 bp, Artificial Sequence
  Description of Artificial Sequence: Synthetic probe
gtcctttgcagtaggaggcttcagcttcccgatatccgacggtagtgttgagtgtccatgaggatgaata

SEQ ID NO: 550 - DNA, 70 bp, Artificial Sequence
  Description of Artificial Sequence: Synthetic probe
acagaagcacagctaagcttcagcttcccgatatccgacggtagtgtactcatggacattattcctaata

SEQ ID NO: 551 - DNA, 70 bp, Artificial Sequence
  Description of Artificial Sequence: Synthetic probe
attggcaaggaactcttgggcttcagcttcccgatatccgacggtagtgttcttatggcaaagtgaaaaa

SEQ ID NO: 552 - DNA, 70 bp, Artificial Sequence
  Description of Artificial Sequence: Synthetic probe
acaaagtaaaccccgagaacttcagcttcccgatatccgacggtagtgttcatccaagtacctgtattgc

SEQ ID NO: 553 - DNA, 70 bp, Artificial Sequence
  Description of Artificial Sequence: Synthetic probe
tctgttggaaagagaagttcagaggcttcagcttcccgatatccgacggtagtgtttaattccagtttca

SEQ ID NO: 554 - DNA, 70 bp, Artificial Sequence
  Description of Artificial Sequence: Synthetic probe
tgactgtcattgccagcacttcagcttcccgatatccgacggtagtgtgccacatagtaggatgcttgca

SEQ ID NO: 555 - DNA, 70 bp, Artificial Sequence
  Description of Artificial Sequence: Synthetic probe
caccgtagaacacatcactgtcttcagcttcccgatatccgacggtagtgttcctttgcagtaggagggc

SEQ ID NO: 556 - DNA, 70 bp, Artificial Sequence
  Description of Artificial Sequence: Synthetic probe
taatggaccacggccatcttcagcttcccgatatccgacggtagtgtggaacagaagcacagctaagacg

SEQ ID NO: 557 - DNA, 70 bp, Artificial Sequence
  Description of Artificial Sequence: Synthetic probe
gaggtttgggcacaagaagaacttcagcttcccgatatccgacggtagtgtagccaagtgtgtgaaaggt

SEQ ID NO: 558 - DNA, 70 bp, Artificial Sequence
  Description of Artificial Sequence: Synthetic probe
cacatgagctgattggtgtcttcagcttcccgatatccgacggtagtgtgcaagcatggagtggaagacg

SEQ ID NO: 559 - DNA, 70 bp, Artificial Sequence
  Description of Artificial Sequence: Synthetic probe
cctagagcagctctgtaaggcttcagcttcccgatatccgacggtagtgtgaggtggacaggtgcataat

SEQ ID NO: 560 - DNA, 70 bp, Artificial Sequence
  Description of Artificial Sequence: Synthetic probe
caaccagattacagatctgtcccttcagcttcccgatatccgacggtagtgtcctagttactggccatgg

SEQ ID NO: 561 - DNA, 70 bp, Artificial Sequence
  Description of Artificial Sequence: Synthetic probe
agtcatttctcccatggaccttcagcttcccgatatccgacggtagtgtgcagattctggttgtgtgtcc

SEQ ID NO: 562 - DNA, 70 bp, Artificial Sequence
  Description of Artificial Sequence: Synthetic probe
gaggtggacaggtgcataattttatcttcagcttcccgatatccgacggtagtgtctcccttcccctcag

SEQ ID NO: 563 - DNA, 70 bp, Artificial Sequence
  Description of Artificial Sequence: Synthetic probe
tgtaaatcttggtctagaaatgcttcagcttcccgatatccgacggtagtgtagtacctgtactggcata

SEQ ID NO: 564 - DNA, 70 bp, Artificial Sequence
  Description of Artificial Sequence: Synthetic probe
gcagagtgtttcacattcacttcagcttcccgatatccgacggtagtgtagaggtttgggcacaagaaga

SEQ ID NO: 565 - DNA, 70 bp, Artificial Sequence
  Description of Artificial Sequence: Synthetic probe
ttctcatcatcatcaccacacttcagcttcccgatatccgacggtagtgtcacatgagctgattggtgtc

SEQ ID NO: 566 - DNA, 70 bp, Artificial Sequence
  Description of Artificial Sequence: Synthetic probe
tgccacctgttacagtgtcttcagcttcccgatatccgacggtagtgtggcaaccagattacagatctgt

SEQ ID NO: 567 - DNA, 70 bp, Artificial Sequence
  Description of Artificial Sequence: Synthetic probe
gcttctcagacagtcccccttcagcttcccgatatccgacggtagtgtgcagtcatttctcccatggaca

SEQ ID NO: 568 - DNA, 70 bp, Artificial Sequence
  Description of Artificial Sequence: Synthetic probe
agtgtgctccgctgggcctcttcagcttcccgatatccgacggtagtgtagacaaagaagctgaggcctg

SEQ ID NO: 569 - DNA, 70 bp, Artificial Sequence
  Description of Artificial Sequence: Synthetic probe
gcttggtggccacgaacttcagcttcccgatatccgacggtagtgtacaggtgaagtggcctactcaaag

SEQ ID NO: 570 - DNA, 70 bp, Artificial Sequence
  Description of Artificial Sequence: Synthetic probe
tttccaaattatcttggggcttcagcttcccgatatccgacggtagtgtagtatgtagtagaggagaatc

SEQ ID NO: 571 - DNA, 70 bp, Artificial Sequence
  Description of Artificial Sequence: Synthetic probe
aggagccagtagaatgatgcttcagcttcccgatatccgacggtagtgtagtcaaagtcaatgacagtgt

SEQ ID NO: 572 - DNA, 70 bp, Artificial Sequence
  Description of Artificial Sequence: Synthetic probe
gctccaattaaggcactgactcttcagcttcccgatatccgacggtagtgtgtgggaggagacctgctgc

SEQ ID NO: 573 - DNA, 70 bp, Artificial Sequence
  Description of Artificial Sequence: Synthetic probe
gtatgtagtagaggagaatcaccttcagcttcccgatatccgacggtagtgtggaaggaggggaagaggg

SEQ ID NO: 574 - DNA, 70 bp, Artificial Sequence
  Description of Artificial Sequence: Synthetic probe
cacaatgatctgaggaaggggcttcagcttcccgatatccgacggtagtgtcacacacacctttgggcac

SEQ ID NO: 575 - DNA, 70 bp, Artificial Sequence
  Description of Artificial Sequence: Synthetic probe
gggtcaggtccctttgacctgcttcagcttcccgatatccgacggtagtgtgtgtgctccgctgggcctg

SEQ ID NO: 576 - DNA, 70 bp, Artificial Sequence
  Description of Artificial Sequence: Synthetic probe
ttgccctgccaggaggtcttcagcttcccgatatccgacggtagtgtacagcttggtggccacgaagtac

SEQ ID NO: 577 - DNA, 70 bp, Artificial Sequence
  Description of Artificial Sequence: Synthetic probe
aatccctgtttccccagtcttcagcttcccgatatccgacggtagtgtacaggagccagtagaatgatga

SEQ ID NO: 578 - DNA, 70 bp, Artificial Sequence
  Description of Artificial Sequence: Synthetic probe
agtgggacaagccttggcttcagcttcccgatatccgacggtagtgtgctgctccaattaaggcactgac

SEQ ID NO: 579 - DNA, 70 bp, Artificial Sequence
  Description of Artificial Sequence: Synthetic probe
ccttgagtggagtatattttacttcagcttcccgatatccgacggtagtgttcttcagcaatgtgacaag

SEQ ID NO: 580 - DNA, 70 bp, Artificial Sequence
  Description of Artificial Sequence: Synthetic probe
acccaaagggcaaagtacacttcagcttcccgatatccgacggtagtgtccaaagatagcaaccttttgt

SEQ ID NO: 581 - DNA, 70 bp, Artificial Sequence
  Description of Artificial Sequence: Synthetic probe
tctgaatctcagcgccacttcagcttcccgatatccgacggtagtgtttcacacaacatacatacatata

SEQ ID NO: 582 - DNA, 70 bp, Artificial Sequence
  Description of Artificial Sequence: Synthetic probe
aatggttttacctccagccctcttcagcttcccgatatccgacggtagtgttctttcacacacctaccac

SEQ ID NO: 583 - DNA, 70 bp, Artificial Sequence
  Description of Artificial Sequence: Synthetic probe
cttcactgctctggggtcttcagcttcccgatatccgacggtagtgtttatcatctgcatatacatatat

SEQ ID NO: 584 - DNA, 70 bp, Artificial Sequence
  Description of Artificial Sequence: Synthetic probe
cacagtcaatatatctggtacacttcagcttcccgatatccgacggtagtgtactgcatgtacggacatg

SEQ ID NO: 585 - DNA, 70 bp, Artificial Sequence
  Description of Artificial Sequence: Synthetic probe
tcaaggtcaaaaatgcgacttcagcttcccgatatccgacggtagtgtaaagtgaaagtgatcttattca

SEQ ID NO: 586 - DNA, 70 bp, Artificial Sequence
  Description of Artificial Sequence: Synthetic probe
ggtttagaaatgtaaatgagactcttcagcttcccgatatccgacggtagtgtagctcattcccatgggt

SEQ ID NO: 587 - DNA, 70 bp, Artificial Sequence
  Description of Artificial Sequence: Synthetic probe
aaggaaattcgattttcttcttcagcttcccgatatccgacggtagtgtgccaatgcttaaccagaaata

SEQ ID NO: 588 - DNA, 70 bp, Artificial Sequence
  Description of Artificial Sequence: Synthetic probe
tttctgcaattcagaagagagacttcagcttcccgatatccgacggtagtgttgaatctcagcgccattc

SEQ ID NO: 589 - DNA, 70 bp, Artificial Sequence
  Description of Artificial Sequence: Synthetic probe
atttcaccaagtagtttttatctcttcagcttcccgatatccgacggtagtgtggttttacctccagccc

SEQ ID NO: 590 - DNA, 70 bp, Artificial Sequence
  Description of Artificial Sequence: Synthetic probe
ttcttcagcaatgtgacaagaacttcagcttcccgatatccgacggtagtgttcactgctctggggttag

SEQ ID NO: 591 - DNA, 70 bp, Artificial Sequence
  Description of Artificial Sequence: Synthetic probe
caaagatagcaaccttttgtcttcagcttcccgatatccgacggtagtgtcacagtcaatatatctggta

SEQ ID NO: 592 - DNA, 70 bp, Artificial Sequence
  Description of Artificial Sequence: Synthetic probe
gttagctcattcccatgggtcttcagcttcccgatatccgacggtagtgttcaaggtcaaaaatgcgatt

SEQ ID NO: 593 - DNA, 70 bp, Artificial Sequence
  Description of Artificial Sequence: Synthetic probe
ccaatgcttaaccagaaatactcttcagcttcccgatatccgacggtagtgtaagcatagtcttacccaa

SEQ ID NO: 594 - DNA, 70 bp, Artificial Sequence
  Description of Artificial Sequence: Synthetic probe
aacttacctgaaatgtttcttcagcttcccgatatccgacggtagtgtgcaaatcttctgacattttttt

SEQ ID NO: 595 - DNA, 70 bp, Artificial Sequence
  Description of Artificial Sequence: Synthetic probe
atgaaaaatctgtgtggtaagtcttcagcttcccgatatccgacggtagtgtgagcccttctcacttcat

SEQ ID NO: 596 - DNA, 70 bp, Artificial Sequence
  Description of Artificial Sequence: Synthetic probe
ggtggtgttgtgaaggtcacttcagcttcccgatatccgacggtagtgttgattgtctcacatccataat

SEQ ID NO: 597 - DNA, 70 bp, Artificial Sequence
  Description of Artificial Sequence: Synthetic probe
gaataagagtgcaccccatgcttcagcttcccgatatccgacggtagtgtgcaccttccctcataactgt

SEQ ID NO: 598 - DNA, 70 bp, Artificial Sequence
  Description of Artificial Sequence: Synthetic probe
aaaaagttattcctggaatcctccttcagcttcccgatatccgacggtagtgttggaataaaccccattt

SEQ ID NO: 599 - DNA, 70 bp, Artificial Sequence
  Description of Artificial Sequence: Synthetic probe
aagaaccagtcgccaacttcagcttcccgatatccgacggtagtgttcttttggaccaaataaatgattt

SEQ ID NO: 600 - DNA, 70 bp, Artificial Sequence
  Description of Artificial Sequence: Synthetic probe
acatataataagaacacagtgcttcagcttcccgatatccgacggtagtgttgtcataggaatcttcact

SEQ ID NO: 601 - DNA, 70 bp, Artificial Sequence
  Description of Artificial Sequence: Synthetic probe
aacatctgtgcctgagataacttcagcttcccgatatccgacggtagtgtggtggtgttgtgaaggtcaa

SEQ ID NO: 602 - DNA, 70 bp, Artificial Sequence
  Description of Artificial Sequence: Synthetic probe
tataagcagaaagaaaaagatgaaccttcagcttcccgatatccgacggtagtgtagagtgcaccccatg

SEQ ID NO: 603 - DNA, 70 bp, Artificial Sequence
  Description of Artificial Sequence: Synthetic probe
aaatcttctgacatttttttgccttcagcttcccgatatccgacggtagtgtaaagttattcctggaatc

SEQ ID NO: 604 - DNA, 70 bp, Artificial Sequence
  Description of Artificial Sequence: Synthetic probe
ttgagcccttctcacttccttcagcttcccgatatccgacggtagtgtaccttaatgtaatgaaacatct

SEQ ID NO: 605 - DNA, 70 bp, Artificial Sequence
  Description of Artificial Sequence: Synthetic probe
ttggaccaaataaatgacttcagcttcccgatatccgacggtagtgtacttataaattaataacattaac

SEQ ID NO: 606 - DNA, 70 bp, Artificial Sequence
  Description of Artificial Sequence: Synthetic probe
atgtcataggaatcttcactgtcttcagcttcccgatatccgacggtagtgtaaagtacaagtcctttgc

SEQ ID NO: 607 - DNA, 70 bp, Artificial Sequence
  Description of Artificial Sequence: Synthetic probe
aaatactttaaaacccaatggtcttcagcttcccgatatccgacggtagtgtgggtagtggagccagaga

SEQ ID NO: 608 - DNA, 70 bp, Artificial Sequence
  Description of Artificial Sequence: Synthetic probe
ctaagattggtaagacagctcttcagcttcccgatatccgacggtagtgtaggatgctcaatcagataaa

SEQ ID NO: 609 - DNA, 70 bp, Artificial Sequence
  Description of Artificial Sequence: Synthetic probe
ccttcaatacgttttacttcacttcagcttcccgatatccgacggtagtgtacgagtggtcgcatatttg

SEQ ID NO: 610 - DNA, 70 bp, Artificial Sequence
  Description of Artificial Sequence: Synthetic probe
ctttgcttcaacagagtcaacttcagcttcccgatatccgacggtagtgtttacccacaggatacttggc

SEQ ID NO: 611 - DNA, 70 bp, Artificial Sequence
  Description of Artificial Sequence: Synthetic probe
aggtaaaaaccgtatgttttgtcttcagcttcccgatatccgacggtagtgtgttatgacagtgggaact

SEQ ID NO: 612 - DNA, 70 bp, Artificial Sequence
  Description of Artificial Sequence: Synthetic probe
gaaaaaaatcaaaaacgtctcttcagcttcccgatatccgacggtagtgtagtttcagctaggacatatt

SEQ ID NO: 613 - DNA, 70 bp, Artificial Sequence
  Description of Artificial Sequence: Synthetic probe
cagggtagtggagccacttcagcttcccgatatccgacggtagtgttaaaataagataaaaaataaattt

SEQ ID NO: 614 - DNA, 70 bp, Artificial Sequence
  Description of Artificial Sequence: Synthetic probe
aggatgctcaatcagataaacttcagcttcccgatatccgacggtagtgtagcaagactctgtctcaaaa

SEQ ID NO: 615 - DNA, 70 bp, Artificial Sequence
  Description of Artificial Sequence: Synthetic probe
aacgagtggtcgcatatttgaggcttcagcttcccgatatccgacggtagtgtcggactccagcctgggt

SEQ ID NO: 616 - DNA, 70 bp, Artificial Sequence
  Description of Artificial Sequence: Synthetic probe
catcatggaaaatatttgagacacttcagcttcccgatatccgacggtagtgtggctgaggaccaacttc

SEQ ID NO: 617 - DNA, 70 bp, Artificial Sequence
  Description of Artificial Sequence: Synthetic probe
attattaaaaaggtaaaccatgcttcagcttcccgatatccgacggtagtgtagatatcagctctcagaa

SEQ ID NO: 618 - DNA, 70 bp, Artificial Sequence
  Description of Artificial Sequence: Synthetic probe
caagatttagaattatgttgcttcagcttcccgatatccgacggtagtgtgtttaatcatttttctcatt

SEQ ID NO: 619 - DNA, 70 bp, Artificial Sequence
  Description of Artificial Sequence: Synthetic probe
tataaaactaagcatcttcagcttcccgatatccgacggtagtgtcattgaaatgatgtataaaatcaag

SEQ ID NO: 620 - DNA, 70 bp, Artificial Sequence
  Description of Artificial Sequence: Synthetic probe
catttatataagtatgaaaacttcagcttcccgatatccgacggtagtgtccttcattattacttacctt

SEQ ID NO: 621 - DNA, 70 bp, Artificial Sequence
  Description of Artificial Sequence: Synthetic probe
ctaggtacagaaggagagacttcagcttcccgatatccgacggtagtgttttggtggttaagtttgataa

SEQ ID NO: 622 - DNA, 70 bp, Artificial Sequence
  Description of Artificial Sequence: Synthetic probe
tgaggctgaggaccaactcttcagcttcccgatatccgacggtagtgtcccaggttccaattgttattta

SEQ ID NO: 623 - DNA, 70 bp, Artificial Sequence
  Description of Artificial Sequence: Synthetic probe
caagatatcagctctcagaacccttcagcttcccgatatccgacggtagtgttctttagcatggcaaatc

SEQ ID NO: 624 - DNA, 70 bp, Artificial Sequence
  Description of Artificial Sequence: Synthetic probe
gtttaatcatttttctcacttcagcttcccgatatccgacggtagtgttgaataaaaattttaaaaagca

SEQ ID NO: 625 - DNA, 70 bp, Artificial Sequence
  Description of Artificial Sequence: Synthetic probe
aaatgatgtataaaatcaagagccttcagcttcccgatatccgacggtagtgtccattggggaatagctg

SEQ ID NO: 626 - DNA, 70 bp, Artificial Sequence
  Description of Artificial Sequence: Synthetic probe
agttcgagaacagcctggccacttcagcttcccgatatccgacggtagtgttcaatggcgcagggaggaa

SEQ ID NO: 627 - DNA, 70 bp, Artificial Sequence
  Description of Artificial Sequence: Synthetic probe
gttgggtggatcacctgagcttcagcttcccgatatccgacggtagtgttcaactttctctataatttta

SEQ ID NO: 628 - DNA, 70 bp, Artificial Sequence
  Description of Artificial Sequence: Synthetic probe
tcatcccagcactttgggaggcttcagcttcccgatatccgacggtagtgtctccattttcatcccgggg

SEQ ID NO: 629 - DNA, 70 bp, Artificial Sequence
  Description of Artificial Sequence: Synthetic probe
ggccgggtgtggtggccttcagcttcccgatatccgacggtagtgtgcagattaggatggatgatagcag

SEQ ID NO: 630 - DNA, 70 bp, Artificial Sequence
  Description of Artificial Sequence: Synthetic probe
tcaatggcaactaaaaacacttcagcttcccgatatccgacggtagtgtaaagaaagaacaaatgttacc

SEQ ID NO: 631 - DNA, 70 bp, Artificial Sequence
  Description of Artificial Sequence: Synthetic probe
tttcctatgacaaaaacaacttcagcttcccgatatccgacggtagtgtacagcattattattttcaaca

SEQ ID NO: 632 - DNA, 70 bp, Artificial Sequence
  Description of Artificial Sequence: Synthetic probe
ctcaatggcgcagggaggcttcagcttcccgatatccgacggtagtgttgagctataaacttctattcaa

SEQ ID NO: 633 - DNA, 70 bp, Artificial Sequence
  Description of Artificial Sequence: Synthetic probe
caactttctctataattttatagaccttcagcttcccgatatccgacggtagtgttgtacgcgaagtgct

SEQ ID NO: 634 - DNA, 70 bp, Artificial Sequence
  Description of Artificial Sequence: Synthetic probe
tctccattttcatcccggggcttcagcttcccgatatccgacggtagtgtagtgtctaatgagagcatca

SEQ ID NO: 635 - DNA, 70 bp, Artificial Sequence
  Description of Artificial Sequence: Synthetic probe
attaggatggatgatagcagcaacttcagcttcccgatatccgacggtagtgtaacatcttccctatcta

SEQ ID NO: 636 - DNA, 70 bp, Artificial Sequence
  Description of Artificial Sequence: Synthetic probe
cgaggcattgagatgcaggccttcagcttcccgatatccgacggtagtgtcccaggatgcagtggtttcc

SEQ ID NO: 637 - DNA, 70 bp, Artificial Sequence
  Description of Artificial Sequence: Synthetic probe
tgttgttttaaaagagatacttcttcagcttcccgatatccgacggtagtgttcaagagttaaaaacatg

SEQ ID NO: 638 - DNA, 70 bp, Artificial Sequence
  Description of Artificial Sequence: Synthetic probe
tcttttcgtaatatgcggcccttcagcttcccgatatccgacggtagtgtaaggcacaaccctactctta

SEQ ID NO: 639 - DNA, 70 bp, Artificial Sequence
  Description of Artificial Sequence: Synthetic probe
ttagttgtctttgcaaaagcttcttcagcttcccgatatccgacggtagtgtaggagctatgtatgcagt

SEQ ID NO: 640 - DNA, 70 bp, Artificial Sequence
  Description of Artificial Sequence: Synthetic probe
aatactttttgcattgagcgttcttcagcttcccgatatccgacggtagtgttgcctaccgaataaggca

SEQ ID NO: 641 - DNA, 70 bp, Artificial Sequence
  Description of Artificial Sequence: Synthetic probe
agacaactaacaaattacagtattcttcagcttcccgatatccgacggtagtgtcgcccagtgggatcgt

SEQ ID NO: 642 - DNA, 70 bp, Artificial Sequence
  Description of Artificial Sequence: Synthetic probe
cctctaaaaatttatgtcagactctcttcagcttcccgatatccgacggtagtgtacacggggtacacgg

SEQ ID NO: 643 - DNA, 70 bp, Artificial Sequence
  Description of Artificial Sequence: Synthetic probe
taaatatattatatttggtttttctcttcagcttcccgatatccgacggtagtgttcgtaatatgcggcc

SEQ ID NO: 644 - DNA, 70 bp, Artificial Sequence
  Description of Artificial Sequence: Synthetic probe
tgatcctctcaggaaacaatcacttcagcttcccgatatccgacggtagtgtagttgtctttgcaaaagc

SEQ ID NO: 645 - DNA, 70 bp, Artificial Sequence
  Description of Artificial Sequence: Synthetic probe
cccaggatgcagtggttcttcagcttcccgatatccgacggtagtgtgcgaatactttttgcattgagcg

SEQ ID NO: 646 - DNA, 70 bp, Artificial Sequence
  Description of Artificial Sequence: Synthetic probe
catcaagagttaaaaacatgggatccttcagcttcccgatatccgacggtagtgtttctaatgtaaacag

SEQ ID NO: 647 - DNA, 70 bp, Artificial Sequence
  Description of Artificial Sequence: Synthetic probe
tctccgcccagtgggatcgcttcagcttcccgatatccgacggtagtgtgacaccgtgtaagatgtaagc

SEQ ID NO: 648 - DNA, 70 bp, Artificial Sequence
  Description of Artificial Sequence: Synthetic probe
cacaaacacggggtacacgcttcagcttcccgatatccgacggtagtgtgcttacagactagcagaattt

SEQ ID NO: 649 - DNA, 70 bp, Artificial Sequence
  Description of Artificial Sequence: Synthetic probe
tctgtggtagatagaatgcacagagcttcagcttcccgatatccgacggtagtgtccctcgctgcagcga

SEQ ID NO: 650 - DNA, 70 bp, Artificial Sequence
  Description of Artificial Sequence: Synthetic probe
gacaagaaaaccatcttcttccccttcagcttcccgatatccgacggtagtgtggctcaaaccacggttt

SEQ ID NO: 651 - DNA, 70 bp, Artificial Sequence
  Description of Artificial Sequence: Synthetic probe
cctgacgcaaactccagcaccatcttcagcttcccgatatccgacggtagtgttgccgcagcagcaggag

SEQ ID NO: 652 - DNA, 70 bp, Artificial Sequence
  Description of Artificial Sequence: Synthetic probe
agattcggggctgcccttcagcttcccgatatccgacggtagtgtctcacagatctagccagtccccgag

SEQ ID NO: 653 - DNA, 70 bp, Artificial Sequence
  Description of Artificial Sequence: Synthetic probe
cagcggtccggcactccttcagcttcccgatatccgacggtagtgtggaaaaccgcctggggcccaggta

SEQ ID NO: 654 - DNA, 70 bp, Artificial Sequence
  Description of Artificial Sequence: Synthetic probe
accgccatcttggctaacacttcagcttcccgatatccgacggtagtgttttacatccctaatccccttt

SEQ ID NO: 655 - DNA, 70 bp, Artificial Sequence
  Description of Artificial Sequence: Synthetic probe
ccagaccctcgctgcagccttcagcttcccgatatccgacggtagtgtagggaccccacactctgaagat

SEQ ID NO: 656 - DNA, 70 bp, Artificial Sequence
  Description of Artificial Sequence: Synthetic probe
cctggctcaaaccacggtcttcagcttcccgatatccgacggtagtgttgacagcccttccttcatatcc

SEQ ID NO: 657 - DNA, 70 bp, Artificial Sequence
  Description of Artificial Sequence: Synthetic probe
ggctgccgcagcagcacttcagcttcccgatatccgacggtagtgtggagtctcccactctttttccctt

SEQ ID NO: 658 - DNA, 70 bp, Artificial Sequence
  Description of Artificial Sequence: Synthetic probe
cctgactcacagggtctgagcccttcagcttcccgatatccgacggtagtgtaactgctgctgctgcctg

SEQ ID NO: 659 - DNA, 70 bp, Artificial Sequence
  Description of Artificial Sequence: Synthetic probe
catgtggccccagtgaactctcttcagcttcccgatatccgacggtagtgtactggggcttgtcatccag

SEQ ID NO: 660 - DNA, 70 bp, Artificial Sequence
  Description of Artificial Sequence: Synthetic probe
tagatggggattccagagatgacttcagcttcccgatatccgacggtagtgtaggcacagatagacgtgg

SEQ ID NO: 661 - DNA, 70 bp, Artificial Sequence
  Description of Artificial Sequence: Synthetic probe
ctggccttgccggtccacttcagcttcccgatatccgacggtagtgtagcaccttctccttcggcagctg

SEQ ID NO: 662 - DNA, 70 bp, Artificial Sequence
  Description of Artificial Sequence: Synthetic probe
gggggtcctcgctggggtcttcagcttcccgatatccgacggtagtgtagtgtcatgctcttgtagagct

SEQ ID NO: 663 - DNA, 70 bp, Artificial Sequence
  Description of Artificial Sequence: Synthetic probe
gcaggcaggcggcatggtgcttcagcttcccgatatccgacggtagtgtctataaactccgccgaggccc

SEQ ID NO: 664 - DNA, 70 bp, Artificial Sequence
  Description of Artificial Sequence: Synthetic probe
ggtttccgctggctcagcccttcagcttcccgatatccgacggtagtgtttgggctggatgaattccaac

SEQ ID NO: 665 - DNA, 70 bp, Artificial Sequence
  Description of Artificial Sequence: Synthetic probe
ccacctgcatcagaagcacttcagcttcccgatatccgacggtagtgtggtagatggggattccagagat

SEQ ID NO: 666 - DNA, 70 bp, Artificial Sequence
  Description of Artificial Sequence: Synthetic probe
gtgctggggaagagagcagaggcttcagcttcccgatatccgacggtagtgtggccttgccggtccatga

SEQ ID NO: 667 - DNA, 70 bp, Artificial Sequence
  Description of Artificial Sequence: Synthetic probe
aaaactgctgctgctgcctgcttcagcttcccgatatccgacggtagtgtgggggtcctcgctggggttg

SEQ ID NO: 668 - DNA, 70 bp, Artificial Sequence
  Description of Artificial Sequence: Synthetic probe
aactggggcttgtcatccagagatgcttcagcttcccgatatccgacggtagtgtggggaggccgcctct

SEQ ID NO: 669 - DNA, 70 bp, Artificial Sequence
  Description of Artificial Sequence: Synthetic probe
tataaactccgccgaggcccctggcttcagcttcccgatatccgacggtagtgtcctgggcgtggggggc

SEQ ID NO: 670 - DNA, 70 bp, Artificial Sequence
  Description of Artificial Sequence: Synthetic probe
tgggctggatgaattccaactcttcagcttcccgatatccgacggtagtgttgggaccagagaggagaca

SEQ ID NO: 671 - DNA, 70 bp, Artificial Sequence
  Description of Artificial Sequence: Synthetic probe
gatgatctggccttgccggtccttcagcttcccgatatccgacggtagtgttcagcaccttctccttcgg

SEQ ID NO: 672 - DNA, 70 bp, Artificial Sequence
  Description of Artificial Sequence: Synthetic probe
tcacgtgggggtcctcgccttcagcttcccgatatccgacggtagtgtttaagcagtgtcatgctcttgt

SEQ ID NO: 673 - DNA, 70 bp, Artificial Sequence
  Description of Artificial Sequence: Synthetic probe
cacgggaagtgggggaggccttcagcttcccgatatccgacggtagtgttcatagaggatgcggtccatg

SEQ ID NO: 674 - DNA, 70 bp, Artificial Sequence
  Description of Artificial Sequence: Synthetic probe
aggcaaggggcctgggcgtgcttcagcttcccgatatccgacggtagtgttccccacgcacctgccgctg

SEQ ID NO: 675 - DNA, 70 bp, Artificial Sequence
  Description of Artificial Sequence: Synthetic probe
gggcagttgggaccagagaggagaccttcagcttcccgatatccgacggtagtgtgccccccgcccctag

SEQ ID NO: 676 - DNA, 70 bp, Artificial Sequence
  Description of Artificial Sequence: Synthetic probe
gcgggtggaggcacagatagacttcagcttcccgatatccgacggtagtgtacacaggtaggggacctca

SEQ ID NO: 677 - DNA, 70 bp, Artificial Sequence
  Description of Artificial Sequence: Synthetic probe
ttcagcaccttctccttcggcttcagcttcccgatatccgacggtagtgtccttgggagccattcctttg

SEQ ID NO: 678 - DNA, 70 bp, Artificial Sequence
  Description of Artificial Sequence: Synthetic probe
aagcagtgtcatgctcttgtcttcagcttcccgatatccgacggtagtgtacccccccaaaaaagaatct

SEQ ID NO: 679 - DNA, 70 bp, Artificial Sequence
  Description of Artificial Sequence: Synthetic probe
catagaggatgcggtccatggcttcagcttcccgatatccgacggtagtgtagagaaccctcagaactct

SEQ ID NO: 680 - DNA, 70 bp, Artificial Sequence
  Description of Artificial Sequence: Synthetic probe
caggccatgctggggttcccttcagcttcccgatatccgacggtagtgtgtcatgtagaaggagatccgg

SEQ ID NO: 681 - DNA, 70 bp, Artificial Sequence
  Description of Artificial Sequence: Synthetic probe
gtcctcctgaaggccagtcctcttcagcttcccgatatccgacggtagtgtgcgtgccctcctcaccata

SEQ ID NO: 682 - DNA, 70 bp, Artificial Sequence
  Description of Artificial Sequence: Synthetic probe
cttccaacacctccatgaattcacacttcagcttcccgatatccgacggtagtgtgggcggcggcactcc

SEQ ID NO: 683 - DNA, 70 bp, Artificial Sequence
  Description of Artificial Sequence: Synthetic probe
agagagccatccaaatcctgccccttcagcttcccgatatccgacggtagtgtggccaaacaccaggtcc

SEQ ID NO: 684 - DNA, 70 bp, Artificial Sequence
  Description of Artificial Sequence: Synthetic probe
acaattggttatgctgggcaacttcagcttcccgatatccgacggtagtgtggacagacgtacctgcctc

SEQ ID NO: 685 - DNA, 70 bp, Artificial Sequence
  Description of Artificial Sequence: Synthetic probe
ggggtgtagaggggaccgggcttcagcttcccgatatccgacggtagtgtcaatggggaccacagggcca

SEQ ID NO: 686 - DNA, 70 bp, Artificial Sequence
  Description of Artificial Sequence: Synthetic probe
tcatgtagaaggagatccggccttcagcttcccgatatccgacggtagtgttcagaaaaactaaagtgta

SEQ ID NO: 687 - DNA, 70 bp, Artificial Sequence
  Description of Artificial Sequence: Synthetic probe
tgcgtgccctcctcaccacttcagcttcccgatatccgacggtagtgttggcactatgctgctcctggaa

SEQ ID NO: 688 - DNA, 70 bp, Artificial Sequence
  Description of Artificial Sequence: Synthetic probe
gtccagggcggcggcacttcagcttcccgatatccgacggtagtgtctcttcttccagctccttagacct

SEQ ID NO: 689 - DNA, 70 bp, Artificial Sequence
  Description of Artificial Sequence: Synthetic probe
actggccaaacaccaggtccttcagcttcccgatatccgacggtagtgttgtctctttcttgcttggaaa

SEQ ID NO: 690 - DNA, 70 bp, Artificial Sequence
  Description of Artificial Sequence: Synthetic probe
ttcagactgactgactctgcccttcagcttcccgatatccgacggtagtgtgtcccgatacatcagcaca

SEQ ID NO: 691 - DNA, 70 bp, Artificial Sequence
  Description of Artificial Sequence: Synthetic probe
gcttgttttaagaggaagactcttcagcttcccgatatccgacggtagtgtgggccatgaatagttccag

SEQ ID NO: 692 - DNA, 70 bp, Artificial Sequence
  Description of Artificial Sequence: Synthetic probe
aagtggcgttccttgcagccttcagcttcccgatatccgacggtagtgtggtgtcaccaacccagaattc

SEQ ID NO: 693 - DNA, 70 bp, Artificial Sequence
  Description of Artificial Sequence: Synthetic probe
ggccagtggagaggagatagtgacttcagcttcccgatatccgacggtagtgtagcacagaccagggctc

SEQ ID NO: 694 - DNA, 70 bp, Artificial Sequence
  Description of Artificial Sequence: Synthetic probe
ctggcaggcagacaggaacttcagcttcccgatatccgacggtagtgtcccaagtcactgatgttgccat

SEQ ID NO: 695 - DNA, 70 bp, Artificial Sequence
  Description of Artificial Sequence: Synthetic probe
agccctgtgggtgacctgcagcttcagcttcccgatatccgacggtagtgtgacaggcatctggcgcccc

SEQ ID NO: 696 - DNA, 70 bp, Artificial Sequence
  Description of Artificial Sequence: Synthetic probe
agtgggcagtacagggggacagcttcagcttcccgatatccgacggtagtgtgtggcgttccttgcagcc

SEQ ID NO: 697 - DNA, 70 bp, Artificial Sequence
  Description of Artificial Sequence: Synthetic probe
gaggggaggaggcaatggtcttcagcttcccgatatccgacggtagtgttggccagtggagaggagatag

SEQ ID NO: 698 - DNA, 70 bp, Artificial Sequence
  Description of Artificial Sequence: Synthetic probe
agtcccgatacatcagcacacccttcagcttcccgatatccgacggtagtgttcctcaccctgagggatc

SEQ ID NO: 699 - DNA, 70 bp, Artificial Sequence
  Description of Artificial Sequence: Synthetic probe
tgggccatgaatagttccagggcttcagcttcccgatatccgacggtagtgtacatgtgcaaggtacagg

SEQ ID NO: 700 - DNA, 70 bp, Artificial Sequence
  Description of Artificial Sequence: Synthetic probe
caagtcactgatgttgccacttcagcttcccgatatccgacggtagtgtcctggacaggggtgtgacatt

SEQ ID NO: 701 - DNA, 70 bp, Artificial Sequence
  Description of Artificial Sequence: Synthetic probe
ggacaggcatctggcgccccttcagcttcccgatatccgacggtagtgtcagaaggcaggcaaaagagct

SEQ ID NO: 702 - DNA, 70 bp, Artificial Sequence
  Description of Artificial Sequence: Synthetic probe
cacctcagctcctgatgcccccttcagcttcccgatatccgacggtagtgttgcgtacgccgcccccacc

SEQ ID NO: 703 - DNA, 70 bp, Artificial Sequence
  Description of Artificial Sequence: Synthetic probe
caccaggcttcaaggggaaaggcttcagcttcccgatatccgacggtagtgtcctgttggcattggcccg

SEQ ID NO: 704 - DNA, 70 bp, Artificial Sequence
  Description of Artificial Sequence: Synthetic probe
agtgtggcagcgaagttgaagccgcttcagcttcccgatatccgacggtagtgtggattggggagggaag

SEQ ID NO: 705 - DNA, 70 bp, Artificial Sequence
  Description of Artificial Sequence: Synthetic probe
gcagaagaagatgatggggcactcttcagcttcccgatatccgacggtagtgtagggtaggggtggcagg

SEQ ID NO: 706 - DNA, 70 bp, Artificial Sequence
  Description of Artificial Sequence: Synthetic probe
tggagatggcgtagccattgtcttcagcttcccgatatccgacggtagtgtcaggacacaggacgagaac

SEQ ID NO: 707 - DNA, 70 bp, Artificial Sequence
  Description of Artificial Sequence: Synthetic probe
ccgcgatactgctcagaggtggcttcagcttcccgatatccgacggtagtgttggctgaccaagtgccag

SEQ ID NO: 708 - DNA, 70 bp, Artificial Sequence
  Description of Artificial Sequence: Synthetic probe
ctcaagcgtggctcaggccacttcagcttcccgatatccgacggtagtgtcccctcgccgaagtaacaga

SEQ ID NO: 709 - DNA, 70 bp, Artificial Sequence
  Description of Artificial Sequence: Synthetic probe
tcattcacactcacatgacccacgcttcagcttcccgatatccgacggtagtgtggcgtccccctcactg

SEQ ID NO: 710 - DNA, 70 bp, Artificial Sequence
  Description of Artificial Sequence: Synthetic probe
ggcggagactcacatgcactcttcagcttcccgatatccgacggtagtgtagtgtggcagcgaagttgaa

SEQ ID NO: 711 - DNA, 70 bp, Artificial Sequence
  Description of Artificial Sequence: Synthetic probe
aggggatgagagggtggtgcttcagcttcccgatatccgacggtagtgtggcagaagaagatgatggggc

SEQ ID NO: 712 - DNA, 70 bp, Artificial Sequence
  Description of Artificial Sequence: Synthetic probe
ctgcgtacgccgcccccacttcagcttcccgatatccgacggtagtgtcgtggagatggcgtagccattg

SEQ ID NO: 713 - DNA, 70 bp, Artificial Sequence
  Description of Artificial Sequence: Synthetic probe
accctgttggcattggcccgcttcttcagcttcccgatatccgacggtagtgtcgatactgctcagaggt

SEQ ID NO: 714 - DNA, 70 bp, Artificial Sequence
  Description of Artificial Sequence: Synthetic probe
cccctcgccgaagtaacagacttcagcttcccgatatccgacggtagtgtagcagagcccataccaatgc

SEQ ID NO: 715 - DNA, 70 bp, Artificial Sequence
  Description of Artificial Sequence: Synthetic probe
catgggcgtccccctcactggcttcagcttcccgatatccgacggtagtgtatcccagcggggtggggag

SEQ ID NO: 716 - DNA, 70 bp, Artificial Sequence
  Description of Artificial Sequence: Synthetic probe
acctcaactcctgtggctgacttcagcttcccgatatccgacggtagtgtccacgcggattgacatgatg

SEQ ID NO: 717 - DNA, 70 bp, Artificial Sequence
  Description of Artificial Sequence: Synthetic probe
cagagagcaaggctgagtgctccttcagcttcccgatatccgacggtagtgttacggcaaacacatcatt

SEQ ID NO: 718 - DNA, 70 bp, Artificial Sequence
  Description of Artificial Sequence: Synthetic probe
gccaaggggacgagcagggagcttcagcttcccgatatccgacggtagtgtcgtcgggcctcctttgtgg

SEQ ID NO: 719 - DNA, 70 bp, Artificial Sequence
  Description of Artificial Sequence: Synthetic probe
ggctgagataaggaacatgcacgcttcagcttcccgatatccgacggtagtgtgctggttctctgccaca

SEQ ID NO: 720 - DNA, 70 bp, Artificial Sequence
  Description of Artificial Sequence: Synthetic probe
acacagagaaggcaggtcaggcttcagcttcccgatatccgacggtagtgttgtaggtcatggcctcgat

SEQ ID NO: 721 - DNA, 70 bp, Artificial Sequence
  Description of Artificial Sequence: Synthetic probe
cccggggcctcgtgctgctgtgcttcagcttcccgatatccgacggtagtgtctgacggggggagcggca

SEQ ID NO: 722 - DNA, 70 bp, Artificial Sequence
  Description of Artificial Sequence: Synthetic probe
ccacgcggattgacatgatgcccttcagcttcccgatatccgacggtagtgtggtggctgtcagtgctgt

SEQ ID NO: 723 - DNA, 70 bp, Artificial Sequence
  Description of Artificial Sequence: Synthetic probe
tatacggcaaacacatcacttcagcttcccgatatccgacggtagtgtgacagtgatcgatatgaggaag

SEQ ID NO: 724 - DNA, 70 bp, Artificial Sequence
  Description of Artificial Sequence: Synthetic probe
ccgtcgggcctcctttgtcttcagcttcccgatatccgacggtagtgttcaggtgataaggccatgtttt

SEQ ID NO: 725 - DNA, 70 bp, Artificial Sequence
  Description of Artificial Sequence: Synthetic probe
agggctggttctctgccacagcttcagcttcccgatatccgacggtagtgtaaggcaagggggagatgca

SEQ ID NO: 726 - DNA, 70 bp, Artificial Sequence
  Description of Artificial Sequence: Synthetic probe
gcaacatcaggtgataagcttcagcttcccgatatccgacggtagtgtgaactgtcgtcactggtgctgt

SEQ ID NO: 727 - DNA, 70 bp, Artificial Sequence
  Description of Artificial Sequence: Synthetic probe
aacggaataaaggcaagggggacttcagcttcccgatatccgacggtagtgttcatccaccgagcggtac

SEQ ID NO: 728 - DNA, 70 bp, Artificial Sequence
  Description of Artificial Sequence: Synthetic probe
catcccaccagccttggctcacttcagcttcccgatatccgacggtagtgttcactggggttatccctga

SEQ ID NO: 729 - DNA, 70 bp, Artificial Sequence
  Description of Artificial Sequence: Synthetic probe
ttcctccaggccttctcctgccttcagcttcccgatatccgacggtagtgtggctccacaggccacatct

SEQ ID NO: 730 - DNA, 70 bp, Artificial Sequence
  Description of Artificial Sequence: Synthetic probe
gatgaactagggaaggaggacttcagcttcccgatatccgacggtagtgttggtcctgtttatcccagta

SEQ ID NO: 731 - DNA, 70 bp, Artificial Sequence
  Description of Artificial Sequence: Synthetic probe
gtgggggtcaggagggaggatggcttcagcttcccgatatccgacggtagtgtgtgccgcagccgggaga

SEQ ID NO: 732 - DNA, 70 bp, Artificial Sequence
  Description of Artificial Sequence: Synthetic probe
cccaggtcagtgtgggctcccttcagcttcccgatatccgacggtagtgtcatcccaccagccttggctc

SEQ ID NO: 733 - DNA, 70 bp, Artificial Sequence
  Description of Artificial Sequence: Synthetic probe
ccgatcctgcacaggggcacttcagcttcccgatatccgacggtagtgtcttcctccaggccttctcctg

SEQ ID NO: 734 - DNA, 70 bp, Artificial Sequence
  Description of Artificial Sequence: Synthetic probe
actgtcgtcactggtgctgtggcttcagcttcccgatatccgacggtagtgtccctcaccttcctgcggg

SEQ ID NO: 735 - DNA, 70 bp, Artificial Sequence
  Description of Artificial Sequence: Synthetic probe
cctcatccaccgagcggtacgctcttcagcttcccgatatccgacggtagtgtcagcacaccctcccggg

SEQ ID NO: 736 - DNA, 70 bp, Artificial Sequence
  Description of Artificial Sequence: Synthetic probe
tggtcctgtttatcccagtaattgacttcagcttcccgatatccgacggtagtgtgctctgcaggccgca

SEQ ID NO: 737 - DNA, 70 bp, Artificial Sequence
  Description of Artificial Sequence: Synthetic probe
atagtgccgcagccgggagcttcagcttcccgatatccgacggtagtgtcccagttcggtgttccacaaa

SEQ ID NO: 738 - DNA, 70 bp, Artificial Sequence
  Description of Artificial Sequence: Synthetic probe
tatcctagcagaagtgtaatgcttcagcttcccgatatccgacggtagtgttgctcaaaggcctccatca

SEQ ID NO: 739 - DNA, 70 bp, Artificial Sequence
  Description of Artificial Sequence: Synthetic probe
ttcccacctcgacaatggaaatgacttcagcttcccgatatccgacggtagtgtgggtttgggcttccgc

SEQ ID NO: 740 - DNA, 70 bp, Artificial Sequence
  Description of Artificial Sequence: Synthetic probe
ggcgggccagagactcctgcttcagcttcccgatatccgacggtagtgtctggggaagacagtggtgtgc

SEQ ID NO: 741 - DNA, 70 bp, Artificial Sequence
  Description of Artificial Sequence: Synthetic probe
tagtgctccccgtaggtccttcagcttcccgatatccgacggtagtgtccgctgagtattttagagggag

SEQ ID NO: 742 - DNA, 70 bp, Artificial Sequence
  Description of Artificial Sequence: Synthetic probe
gaattaaccactccaagccttcttcagcttcccgatatccgacggtagtgtacacgtctgagaagagtag

SEQ ID NO: 743 - DNA, 70 bp, Artificial Sequence
  Description of Artificial Sequence: Synthetic probe
cttcctcctgcggggccttggcaacttcagcttcccgatatccgacggtagtgtagctgggcgggcatct

SEQ ID NO: 744 - DNA, 70 bp, Artificial Sequence
  Description of Artificial Sequence: Synthetic probe
agccggcctcccatgcaggaccttcagcttcccgatatccgacggtagtgtgcgggccagagactcctgc

SEQ ID NO: 745 - DNA, 70 bp, Artificial Sequence
  Description of Artificial Sequence: Synthetic probe
ggggacatggggcagtgggcttcagcttcccgatatccgacggtagtgtgtagtgctccccgtaggtctg

SEQ ID NO: 746 - DNA, 70 bp, Artificial Sequence
  Description of Artificial Sequence: Synthetic probe
ctgctcaaaggcctccacttcagcttcccgatatccgacggtagtgtgtctcacttatcgaagtgatcca

SEQ ID NO: 747 - DNA, 70 bp, Artificial Sequence
  Description of Artificial Sequence: Synthetic probe
ggttgggtttgggcttccgctccttcagcttcccgatatccgacggtagtgtggtgggggtgggctgagc

SEQ ID NO: 748 - DNA, 70 bp, Artificial Sequence
  Description of Artificial Sequence: Synthetic probe
tacacgtctgagaagagcttcagcttcccgatatccgacggtagtgttggggctacctctcggggtagct

SEQ ID NO: 749 - DNA, 70 bp, Artificial Sequence
  Description of Artificial Sequence: Synthetic probe
gcggagctgggcgggcatctccttcagcttcccgatatccgacggtagtgtgtccccctgctccccttag

SEQ ID NO: 750 - DNA, 70 bp, Artificial Sequence
  Description of Artificial Sequence: Synthetic probe
gaactggaaatttaggggcggggcttcagcttcccgatatccgacggtagtgtgcagccgccgctacaac

SEQ ID NO: 751 - DNA, 70 bp, Artificial Sequence
  Description of Artificial Sequence: Synthetic probe
gcggtcccatgaaaccttcagcttcccgatatccgacggtagtgtgcccctgccgccctgagcctgagta

SEQ ID NO: 752 - DNA, 70 bp, Artificial Sequence
  Description of Artificial Sequence: Synthetic probe
gacagtcgcggcggggtgcaaaaagcttcagcttcccgatatccgacggtagtgtcctgcccctcgcggg

SEQ ID NO: 753 - DNA, 70 bp, Artificial Sequence
  Description of Artificial Sequence: Synthetic probe
cctgccgcctctgggcccttcagcttcccgatatccgacggtagtgtaagctgggatgcaaggattgcag

SEQ ID NO: 754 - DNA, 70 bp, Artificial Sequence
  Description of Artificial Sequence: Synthetic probe
tctggctggaaagtaaaatgacttcagcttcccgatatccgacggtagtgtccagagagtcaggaagtta

SEQ ID NO: 755 - DNA, 70 bp, Artificial Sequence
  Description of Artificial Sequence: Synthetic probe
cttccacattggtcgggccagagcttcagcttcccgatatccgacggtagtgtgacgccagtgcccctca

SEQ ID NO: 756 - DNA, 70 bp, Artificial Sequence
  Description of Artificial Sequence: Synthetic probe
ggggagggcggagcacccgaggaggcttcagcttcccgatatccgacggtagtgtcgccagccccgcgcc

SEQ ID NO: 757 - DNA, 70 bp, Artificial Sequence
  Description of Artificial Sequence: Synthetic probe
ggctatgcagccgcacgccgcctgccttcagcttcccgatatccgacggtagtgttcgcggcggggtgca

SEQ ID NO: 758 - DNA, 70 bp, Artificial Sequence
  Description of Artificial Sequence: Synthetic probe
tccccgctcaccaccgggattctccttcagcttcccgatatccgacggtagtgtccgcctctgggccgca

SEQ ID NO: 759 - DNA, 70 bp, Artificial Sequence
  Description of Artificial Sequence: Synthetic probe
ccggcagccgccgctcttcagcttcccgatatccgacggtagtgtccggatctggctggaaagtaaaatg

SEQ ID NO: 760 - DNA, 70 bp, Artificial Sequence
  Description of Artificial Sequence: Synthetic probe
tgccgccctgagcctgagtagccttcagcttcccgatatccgacggtagtgtcaccgtactcccggggct

SEQ ID NO: 761 - DNA, 70 bp, Artificial Sequence
  Description of Artificial Sequence: Synthetic probe
gccgacgccagtgcccctcagcttcagcttcccgatatccgacggtagtgtgggaccgagtgggcagtcc

SEQ ID NO: 762 - DNA, 70 bp, Artificial Sequence
  Description of Artificial Sequence: Synthetic probe
ccccgcgccagcccccttcagcttcccgatatccgacggtagtgtcgcctgcgagcctgggagtccgggc

SEQ ID NO: 763 - DNA, 70 bp, Artificial Sequence
  Description of Artificial Sequence: Synthetic probe
tatttaagtatactgtaatatgacttcagcttcccgatatccgacggtagtgtggagcctctaggttcaa

SEQ ID NO: 764 - DNA, 70 bp, Artificial Sequence
  Description of Artificial Sequence: Synthetic probe
caattgcatctaaggacacttcagcttcccgatatccgacggtagtgtggtgtgtcataaccacatactc

SEQ ID NO: 765 - DNA, 70 bp, Artificial Sequence
  Description of Artificial Sequence: Synthetic probe
gatcatttttcgaagggcacttcagcttcccgatatccgacggtagtgttcttctgaaagttgcctttta

SEQ ID NO: 766 - DNA, 70 bp, Artificial Sequence
  Description of Artificial Sequence: Synthetic probe
taaaatatttcacttactaaacttcagcttcccgatatccgacggtagtgttggttcaaaaatgtgagga

SEQ ID NO: 767 - DNA, 70 bp, Artificial Sequence
  Description of Artificial Sequence: Synthetic probe
ctcacagaaatgaaatagtgccttcagcttcccgatatccgacggtagtgtacttccatttgtctgggat

SEQ ID NO: 768 - DNA, 70 bp, Artificial Sequence
  Description of Artificial Sequence: Synthetic probe
tgcttaacttcaagaattttttcttcagcttcccgatatccgacggtagtgttcatttttcgaagggcat

SEQ ID NO: 769 - DNA, 70 bp, Artificial Sequence
  Description of Artificial Sequence: Synthetic probe
attcctcctgcagacagacttcagcttcccgatatccgacggtagtgtgcatacctacctatatggtcaa

SEQ ID NO: 770 - DNA, 70 bp, Artificial Sequence
  Description of Artificial Sequence: Synthetic probe
ataggagcctctaggttcacttcagcttcccgatatccgacggtagtgtggcacatagtagctttctcaa

SEQ ID NO: 771 - DNA, 70 bp, Artificial Sequence
  Description of Artificial Sequence: Synthetic probe
tgtgtcataaccacatactccttcagcttcccgatatccgacggtagtgtggttaacagtacgttaatgt

SEQ ID NO: 772 - DNA, 70 bp, Artificial Sequence
  Description of Artificial Sequence: Synthetic probe
atggttcaaaaatgtgaggaacttcagcttcccgatatccgacggtagtgtaaacactgatgattgctgt

SEQ ID NO: 773 - DNA, 70 bp, Artificial Sequence
  Description of Artificial Sequence: Synthetic probe
cacttccatttgtctgggacttcagcttcccgatatccgacggtagtgtctttaccatcaaagtttgtta

SEQ ID NO: 774 - DNA, 70 bp, Artificial Sequence
  Description of Artificial Sequence: Synthetic probe
atttacaataatactataagacttcagcttcccgatatccgacggtagtgtattcattttctgagtttgc

SEQ ID NO: 775 - DNA, 70 bp, Artificial Sequence
  Description of Artificial Sequence: Synthetic probe
aagatattatgcaaattgctgacttcagcttcccgatatccgacggtagtgtggcacttgttacagactg

SEQ ID NO: 776 - DNA, 70 bp, Artificial Sequence
  Description of Artificial Sequence: Synthetic probe
cttgactaaaatcaaggtacacttcagcttcccgatatccgacggtagtgtggatctttggccaatgagt

SEQ ID NO: 777 - DNA, 70 bp, Artificial Sequence
  Description of Artificial Sequence: Synthetic probe
ccagtttcttaacagttaacttcagcttcccgatatccgacggtagtgtaggcacatatcagggttacct

SEQ ID NO: 778 - DNA, 70 bp, Artificial Sequence
  Description of Artificial Sequence: Synthetic probe
tgtgttgtaaaatacataaaaacacttcagcttcccgatatccgacggtagtgttaacacagctaccaca

SEQ ID NO: 779 - DNA, 70 bp, Artificial Sequence
  Description of Artificial Sequence: Synthetic probe
gaaaatcaaaaaaaaaatcacttcagcttcccgatatccgacggtagtgttattttaagcaaatcttcaa

SEQ ID NO: 780 - DNA, 70 bp, Artificial Sequence
  Description of Artificial Sequence: Synthetic probe
gattcattttctgagtttgccctcttcagcttcccgatatccgacggtagtgttaaccattgagctccac

SEQ ID NO: 781 - DNA, 70 bp, Artificial Sequence
  Description of Artificial Sequence: Synthetic probe
aaggcacttgttacagactcttcagcttcccgatatccgacggtagtgtcctttgaaaatgtcaggtaga

SEQ ID NO: 782 - DNA, 70 bp, Artificial Sequence
  Description of Artificial Sequence: Synthetic probe
aggatctttggccaatgagtcttcagcttcccgatatccgacggtagtgttttgattatttagccccaat

SEQ ID NO: 783 - DNA, 70 bp, Artificial Sequence
  Description of Artificial Sequence: Synthetic probe
agatctcgatcaaggtttctcacttcagcttcccgatatccgacggtagtgttccaccaaaggcaacatc

SEQ ID NO: 784 - DNA, 70 bp, Artificial Sequence
  Description of Artificial Sequence: Synthetic probe
aaatcacaaaagataaatggaccacttcagcttcccgatatccgacggtagtgtaagccaacagtgcatc

SEQ ID NO: 785 - DNA, 70 bp, Artificial Sequence
  Description of Artificial Sequence: Synthetic probe
taagtaatttaaatgtttacacttcagcttcccgatatccgacggtagtgtaggtatttacttaccatat

SEQ ID NO: 786 - DNA, 70 bp, Artificial Sequence
  Description of Artificial Sequence: Synthetic probe
tctaaataatactaacaatgacttcagcttcccgatatccgacggtagtgtagttctatcagaatactat

SEQ ID NO: 787 - DNA, 70 bp, Artificial Sequence
  Description of Artificial Sequence: Synthetic probe
aaataatacattttatttaacttcagcttcccgatatccgacggtagtgtttgtatttttaagatctttt

SEQ ID NO: 788 - DNA, 70 bp, Artificial Sequence
  Description of Artificial Sequence: Synthetic probe
caaatattactgaaaaacagtcttcagcttcccgatatccgacggtagtgtgacaaaaaatttagtaggc

SEQ ID NO: 789 - DNA, 70 bp, Artificial Sequence
  Description of Artificial Sequence: Synthetic probe
actccaccaaaggcaacacttcagcttcccgatatccgacggtagtgtaaggaattcatccatacaatgg

SEQ ID NO: 790 - DNA, 70 bp, Artificial Sequence
  Description of Artificial Sequence: Synthetic probe
tcgcaagccaacagtgcatctacttcagcttcccgatatccgacggtagtgtgcgggtggcgttggaaat

SEQ ID NO: 791 - DNA, 70 bp, Artificial Sequence
  Description of Artificial Sequence: Synthetic probe
taaagagtatggctagccacttcagcttcccgatatccgacggtagtgtggggtattaaaaactctatct

SEQ ID NO: 792 - DNA, 70 bp, Artificial Sequence
  Description of Artificial Sequence: Synthetic probe
tagaacaggtagaggaaacacttcagcttcccgatatccgacggtagtgtccaacaattccttgttcaca

SEQ ID NO: 793 - DNA, 70 bp, Artificial Sequence
  Description of Artificial Sequence: Synthetic probe
gcagggaaaatataatctcttcagcttcccgatatccgacggtagtgtgctcataacaaaattataattg

SEQ ID NO: 794 - DNA, 70 bp, Artificial Sequence
  Description of Artificial Sequence: Synthetic probe
aaactaataatgggatggagaacttcagcttcccgatatccgacggtagtgttgaccgcaattccgattc

SEQ ID NO: 795 - DNA, 70 bp, Artificial Sequence
  Description of Artificial Sequence: Synthetic probe
tgcataatacatttaaaaattcagtcttcagcttcccgatatccgacggtagtgttccgcaatggcagta

SEQ ID NO: 796 - DNA, 70 bp, Artificial Sequence
  Description of Artificial Sequence: Synthetic probe
aatgtggcaaatgagagtacttcagcttcccgatatccgacggtagtgttgcagggaaaatataatctgc

SEQ ID NO: 797 - DNA, 70 bp, Artificial Sequence
  Description of Artificial Sequence: Synthetic probe
ttaaaatagaaaagaaaaaaagcttcagcttcccgatatccgacggtagtgtttcattcacttacctgat

SEQ ID NO: 798 - DNA, 70 bp, Artificial Sequence
  Description of Artificial Sequence: Synthetic probe
gggtattaaaaactctatcttcttcagcttcccgatatccgacggtagtgttcaatgaatgaacaacctt

SEQ ID NO: 799 - DNA, 70 bp, Artificial Sequence
  Description of Artificial Sequence: Synthetic probe
ccaacaattccttgttcacacacttcagcttcccgatatccgacggtagtgtgggtagcggcaatacttg

SEQ ID NO: 800 - DNA, 70 bp, Artificial Sequence
  Description of Artificial Sequence: Synthetic probe
agtgaccgcaattccgattccacttcagcttcccgatatccgacggtagtgtagaatgcaggtaagggtg

SEQ ID NO: 801 - DNA, 70 bp, Artificial Sequence
  Description of Artificial Sequence: Synthetic probe
gaatttccgcaatggcagtcttcagcttcccgatatccgacggtagtgtacattagtaaaaggataataa

SEQ ID NO: 802 - DNA, 70 bp, Artificial Sequence
  Description of Artificial Sequence: Synthetic probe
tgagtctttccctccctccctcttcagcttcccgatatccgacggtagtgtccccagagcgatagcgata

SEQ ID NO: 803 - DNA, 70 bp, Artificial Sequence
  Description of Artificial Sequence: Synthetic probe
ccttccttcccttcccaaggccttcagcttcccgatatccgacggtagtgtgtgaggcttccacagttaa

SEQ ID NO: 804 - DNA, 70 bp, Artificial Sequence
  Description of Artificial Sequence: Synthetic probe
atgggcaaaaaatgcttcaggcttcagcttcccgatatccgacggtagtgtaatacagttaagttcacat

SEQ ID NO: 805 - DNA, 70 bp, Artificial Sequence
  Description of Artificial Sequence: Synthetic probe
tccgttcttcctccctccctcttcagcttcccgatatccgacggtagtgtcaacacagccccaaggggac

SEQ ID NO: 806 - DNA, 70 bp, Artificial Sequence
  Description of Artificial Sequence: Synthetic probe
atgagtccttcccttccaacttcagcttcccgatatccgacggtagtgtctgagaatgatagagagcccc

SEQ ID NO: 807 - DNA, 70 bp, Artificial Sequence
  Description of Artificial Sequence: Synthetic probe
agaaagaaagacggggcatggcttcagcttcccgatatccgacggtagtgttgggcaaaaaatgcttcag

SEQ ID NO: 808 - DNA, 70 bp, Artificial Sequence
  Description of Artificial Sequence: Synthetic probe
cagcttcattaacaatctgaggcttcagcttcccgatatccgacggtagtgtgaacataccttgattcct

SEQ ID NO: 809 - DNA, 70 bp, Artificial Sequence
  Description of Artificial Sequence: Synthetic probe
tccccagagcgatagcgcttcagcttcccgatatccgacggtagtgttcaaatagaaatcaaataaagta

SEQ ID NO: 810 - DNA, 70 bp, Artificial Sequence
  Description of Artificial Sequence: Synthetic probe
agtgaggcttccacagtcttcagcttcccgatatccgacggtagtgtaatagaatgaatcaaaatggaaa

SEQ ID NO: 811 - DNA, 70 bp, Artificial Sequence
  Description of Artificial Sequence: Synthetic probe
caacacagccccaaggggcttcagcttcccgatatccgacggtagtgttcctctagataagcatagatat

SEQ ID NO: 812 - DNA, 70 bp, Artificial Sequence
  Description of Artificial Sequence: Synthetic probe
tgagaatgatagagagcccccttcagcttcccgatatccgacggtagtgtccaagaatcctgtttgtttt

SEQ ID NO: 813 - DNA, 70 bp, Artificial Sequence
  Description of Artificial Sequence: Synthetic probe
gcctaattatcacttattaagcttcagcttcccgatatccgacggtagtgtgggcttctgggtataacca

SEQ ID NO: 814 - DNA, 70 bp, Artificial Sequence
  Description of Artificial Sequence: Synthetic probe
aatagatattggctatttattttaacttcagcttcccgatatccgacggtagtgtagaagtcctttggcc

SEQ ID NO: 815 - DNA, 70 bp, Artificial Sequence
  Description of Artificial Sequence: Synthetic probe
aaataatcaattgttactaacttcagcttcccgatatccgacggtagtgtcaaggatttttatcctctat

SEQ ID NO: 816 - DNA, 70 bp, Artificial Sequence
  Description of Artificial Sequence: Synthetic probe
tcgctgctaagaagggccttcagcttcccgatatccgacggtagtgtgtaaagtattttaggttcaaaaa

SEQ ID NO: 817 - DNA, 70 bp, Artificial Sequence
  Description of Artificial Sequence: Synthetic probe
ttagtaaaaatatatcccagtaaaccttcagcttcccgatatccgacggtagtgttctttacctgctgcc

SEQ ID NO: 818 - DNA, 70 bp, Artificial Sequence
  Description of Artificial Sequence: Synthetic probe
aaaaacagatttttttaagaccttcagcttcccgatatccgacggtagtgtagatattcacaaatataaa

SEQ ID NO: 819 - DNA, 70 bp, Artificial Sequence
  Description of Artificial Sequence: Synthetic probe
agggcttctgggtataaccacttcagcttcccgatatccgacggtagtgtagagctataaaaaacaaagt

SEQ ID NO: 820 - DNA, 70 bp, Artificial Sequence
  Description of Artificial Sequence: Synthetic probe
acaaaagaagtcctttggcccttcagcttcccgatatccgacggtagtgttatagaaaaaaaagatataa

SEQ ID NO: 821 - DNA, 70 bp, Artificial Sequence
  Description of Artificial Sequence: Synthetic probe
caaggatttttatcctctacttcagcttcccgatatccgacggtagtgttctacaaggaaaatataaatc

SEQ ID NO: 822 - DNA, 70 bp, Artificial Sequence
  Description of Artificial Sequence: Synthetic probe
aagtattttaggttcaaaaacttcagcttcccgatatccgacggtagtgtaataccaaaaaaatcaagat

SEQ ID NO: 823 - DNA, 70 bp, Artificial Sequence
  Description of Artificial Sequence: Synthetic probe
aaattctgtattacttaaaacacttcagcttcccgatatccgacggtagtgtgggatgttgtatggttct

SEQ ID NO: 824 - DNA, 70 bp, Artificial Sequence
  Description of Artificial Sequence: Synthetic probe
gctttattttattttttgcttcagcttcccgatatccgacggtagtgtcttcctgtatgacttcggcctg

SEQ ID NO: 825 - DNA, 70 bp, Artificial Sequence
  Description of Artificial Sequence: Synthetic probe
aatttaagaagctcacttcagcttcccgatatccgacggtagtgtccccaggcaactagagtaacatcac

SEQ ID NO: 826 - DNA, 70 bp, Artificial Sequence
  Description of Artificial Sequence: Synthetic probe
ctgaggtgacacttgtgcacttcagcttcccgatatccgacggtagtgttcaatgctactcacctgagtg

SEQ ID NO: 827 - DNA, 70 bp, Artificial Sequence
  Description of Artificial Sequence: Synthetic probe
ggaaaaaaaaaaaaggacacttcagcttcccgatatccgacggtagtgtacaacgtaggttttaacagtt

SEQ ID NO: 828 - DNA, 70 bp, Artificial Sequence
  Description of Artificial Sequence: Synthetic probe
gacttcttccgctaaataccttcagcttcccgatatccgacggtagtgtggatttaaaatgagagcttcc

SEQ ID NO: 829 - DNA, 70 bp, Artificial Sequence
  Description of Artificial Sequence: Synthetic probe
gtgggatgttgtatggttctcttcagcttcccgatatccgacggtagtgttcgttttcaatttttcatgt

SEQ ID NO: 830 - DNA, 70 bp, Artificial Sequence
  Description of Artificial Sequence: Synthetic probe
tcctgtatgacttcggcccttcagcttcccgatatccgacggtagtgtgacttaatctgagatataaaga

SEQ ID NO: 831 - DNA, 70 bp, Artificial Sequence
  Description of Artificial Sequence: Synthetic probe
ggcaactagagtaacatcaccttcagcttcccgatatccgacggtagtgtagaaattagcatcagtagca

SEQ ID NO: 832 - DNA, 70 bp, Artificial Sequence
  Description of Artificial Sequence: Synthetic probe
aaatttgttttaaatatgttgcttcagcttcccgatatccgacggtagtgtacctctcggatcacatgaa

SEQ ID NO: 833 - DNA, 70 bp, Artificial Sequence
  Description of Artificial Sequence: Synthetic probe
gaactgatctgcatggagacttcagcttcccgatatccgacggtagtgtccaagcttttcttttgccatg

SEQ ID NO: 834 - DNA, 70 bp, Artificial Sequence
  Description of Artificial Sequence: Synthetic probe
ttagagacagtatttaaagtctccttcagcttcccgatatccgacggtagtgttcaatgacttcacaaga

SEQ ID NO: 835 - DNA, 70 bp, Artificial Sequence
  Description of Artificial Sequence: Synthetic probe
aactagttgaatgctgacttcagcttcccgatatccgacggtagtgtgtccacatcccaaggtattatag

SEQ ID NO: 836 - DNA, 70 bp, Artificial Sequence
  Description of Artificial Sequence: Synthetic probe
tgactacaaaggttctagcctcttcagcttcccgatatccgacggtagtgttattcataccttacaaatt

SEQ ID NO: 837 - DNA, 70 bp, Artificial Sequence
  Description of Artificial Sequence: Synthetic probe
aataaagagaaaaatatgcagcttcagcttcccgatatccgacggtagtgtgggaaatgacattctatca

SEQ ID NO: 838 - DNA, 70 bp, Artificial Sequence
  Description of Artificial Sequence: Synthetic probe
tacctctcggatcacatgaaccttcagcttcccgatatccgacggtagtgtacaacatatttggccaaag

SEQ ID NO: 839 - DNA, 70 bp, Artificial Sequence
  Description of Artificial Sequence: Synthetic probe
caagcttttcttttgccacttcagcttcccgatatccgacggtagtgtcaatttcaaaagaattatttgc

SEQ ID NO: 840 - DNA, 70 bp, Artificial Sequence
  Description of Artificial Sequence: Synthetic probe
agatcaatgacttcacaagacacttcagcttcccgatatccgacggtagtgttgaaaatgctcacatagc

SEQ ID NO: 841 - DNA, 70 bp, Artificial Sequence
  Description of Artificial Sequence: Synthetic probe
cacatcccaaggtattatcttcagcttcccgatatccgacggtagtgttgctgcaaatttaaaagtttta

SEQ ID NO: 842 - DNA, 70 bp, Artificial Sequence
  Description of Artificial Sequence: Synthetic probe
cagtaattcaattgtatgccaacttcagcttcccgatatccgacggtagtgtctgattagcagtcgccct

SEQ ID NO: 843 - DNA, 70 bp, Artificial Sequence
  Description of Artificial Sequence: Synthetic probe
tacattcaataaatagtgtaaaaacttcagcttcccgatatccgacggtagtgtcgcctgtcaagggagc

SEQ ID NO: 844 - DNA, 70 bp, Artificial Sequence
  Description of Artificial Sequence: Synthetic probe
aaatcagtaataaaagtaaattacttcagcttcccgatatccgacggtagtgttgtagagctgatttccg

SEQ ID NO: 845 - DNA, 70 bp, Artificial Sequence
  Description of Artificial Sequence: Synthetic probe
attttatatatatgatggtagtcttcagcttcccgatatccgacggtagtgtagttccaaaaattactct

SEQ ID NO: 846 - DNA, 70 bp, Artificial Sequence
  Description of Artificial Sequence: Synthetic probe
aaacctgatgttaaaaagaatcttcagcttcccgatatccgacggtagtgttgtggaattgcacaagcat

SEQ ID NO: 847 - DNA, 70 bp, Artificial Sequence
  Description of Artificial Sequence: Synthetic probe
gatcacagactgaaagagacttcagcttcccgatatccgacggtagtgtgtaatttattttcttctggaa

SEQ ID NO: 848 - DNA, 70 bp, Artificial Sequence
  Description of Artificial Sequence: Synthetic probe
gactgattagcagtcgccccttcagcttcccgatatccgacggtagtgttgtatgctttcacatattgtg

SEQ ID NO: 849 - DNA, 70 bp, Artificial Sequence
  Description of Artificial Sequence: Synthetic probe
aagccgcctgtcaagggacttcagcttcccgatatccgacggtagtgtaaagcatgcactacatttccat

SEQ ID NO: 850 - DNA, 70 bp, Artificial Sequence
  Description of Artificial Sequence: Synthetic probe
aactgtagagctgatttccgcttcagcttcccgatatccgacggtagtgtaaatttacttatcacagtat

SEQ ID NO: 851 - DNA, 70 bp, Artificial Sequence
  Description of Artificial Sequence: Synthetic probe
aggacttttttttttttttttttcttcagcttcccgatatccgacggtagtgtttattttgaggaacagc

SEQ ID NO: 852 - DNA, 70 bp, Artificial Sequence
  Description of Artificial Sequence: Synthetic probe
ttgttccaactgtgcccagacttcagcttcccgatatccgacggtagtgttgagtgacgttctagttgct

SEQ ID NO: 853 - DNA, 70 bp, Artificial Sequence
  Description of Artificial Sequence: Synthetic probe
aggaaggacttgattcacttcagcttcccgatatccgacggtagtgtgacttaatttattattaagtgtt

SEQ ID NO: 854 - DNA, 70 bp, Artificial Sequence
  Description of Artificial Sequence: Synthetic probe
attaatcacaatgttttttgacttcagcttcccgatatccgacggtagtgtacgaaaattttggttttga

SEQ ID NO: 855 - DNA, 70 bp, Artificial Sequence
  Description of Artificial Sequence: Synthetic probe
aaatcagtggagttaggtactcttcagcttcccgatatccgacggtagtgttgacagcaaaccagtcaaa

SEQ ID NO: 856 - DNA, 70 bp, Artificial Sequence
  Description of Artificial Sequence: Synthetic probe
taatcctaaaaagtgagggaacttcagcttcccgatatccgacggtagtgtacaatgtggtaagttagtg

SEQ ID NO: 857 - DNA, 70 bp, Artificial Sequence
  Description of Artificial Sequence: Synthetic probe
agattattttgaggaacagccttcagcttcccgatatccgacggtagtgtgtttaaagagaagatatctc

SEQ ID NO: 858 - DNA, 70 bp, Artificial Sequence
  Description of Artificial Sequence: Synthetic probe
tgagtgacgttctagttgccttcagcttcccgatatccgacggtagtgtcatttcctcatctgtacaatg

SEQ ID NO: 859 - DNA, 70 bp, Artificial Sequence
  Description of Artificial Sequence: Synthetic probe
ttaatttattattaagtgttctggccttcagcttcccgatatccgacggtagtgttcaatgaatctctca

SEQ ID NO: 860 - DNA, 70 bp, Artificial Sequence
  Description of Artificial Sequence: Synthetic probe
cggtggctcacgcctgtcttcagcttcccgatatccgacggtagtgttctccagagtagaaatgagtctg

SEQ ID NO: 861 - DNA, 70 bp, Artificial Sequence
  Description of Artificial Sequence: Synthetic probe
attaaaacctctataaggccggcttcagcttcccgatatccgacggtagtgtgagcttcctctcatagag

SEQ ID NO: 862 - DNA, 70 bp, Artificial Sequence
  Description of Artificial Sequence: Synthetic probe
caaattccatcacaacttcttcagcttcccgatatccgacggtagtgttgtgcttcatcaataacaaaac

SEQ ID NO: 863 - DNA, 70 bp, Artificial Sequence
  Description of Artificial Sequence: Synthetic probe
catcacctcatgattctgtggcttcagcttcccgatatccgacggtagtgtagtatttacctgactgaca

SEQ ID NO: 864 - DNA, 70 bp, Artificial Sequence
  Description of Artificial Sequence: Synthetic probe
ttagacatgtaaaaacactgaacttcagcttcccgatatccgacggtagtgttcggtatttccggatata

SEQ ID NO: 865 - DNA, 70 bp, Artificial Sequence
  Description of Artificial Sequence: Synthetic probe
tgcacagatctaggccagacttcagcttcccgatatccgacggtagtgttacatatattgttggtagtat

SEQ ID NO: 866 - DNA, 70 bp, Artificial Sequence
  Description of Artificial Sequence: Synthetic probe
ccagagtagaaatgagtctgtcttcagcttcccgatatccgacggtagtgtagtgtgggtttttattcag

SEQ ID NO: 867 - DNA, 70 bp, Artificial Sequence
  Description of Artificial Sequence: Synthetic probe
aagagcttcctctcatagagcttcagcttcccgatatccgacggtagtgtcagtaaaataggagactcgt

SEQ ID NO: 868 - DNA, 70 bp, Artificial Sequence
  Description of Artificial Sequence: Synthetic probe
tgcttcatcaataacaaaaccttcagcttcccgatatccgacggtagtgtatgtattaagaactacctta

SEQ ID NO: 869 - DNA, 70 bp, Artificial Sequence
  Description of Artificial Sequence: Synthetic probe
tgtgggtttttattcagtcttcagcttcccgatatccgacggtagtgttgtaatcttgacgaaaatcatg

SEQ ID NO: 870 - DNA, 70 bp, Artificial Sequence
  Description of Artificial Sequence: Synthetic probe
taaaataggagactcgttcaccttcagcttcccgatatccgacggtagtgttggcgaagcatattcattc

SEQ ID NO: 871 - DNA, 70 bp, Artificial Sequence
  Description of Artificial Sequence: Synthetic probe
ctgagtcaggatgtccttctgtacccttcagcttcccgatatccgacggtagtgtgggcatgggggtggg

SEQ ID NO: 872 - DNA, 70 bp, Artificial Sequence
  Description of Artificial Sequence: Synthetic probe
tattaagaactaccttattcttcacttcagcttcccgatatccgacggtagtgtcaccggaacagaagga

SEQ ID NO: 873 - DNA, 70 bp, Artificial Sequence
  Description of Artificial Sequence: Synthetic probe
tataaaaagccaacactgctcacttcagcttcccgatatccgacggtagtgtgggattagctgtggccgt

SEQ ID NO: 874 - DNA, 70 bp, Artificial Sequence
  Description of Artificial Sequence: Synthetic probe
tttcagactacttggagctcttcagcttcccgatatccgacggtagtgtgctgagtcaggatgtccttct

SEQ ID NO: 875 - DNA, 70 bp, Artificial Sequence
  Description of Artificial Sequence: Synthetic probe
actagttggaaaaaaaaatactcttcagcttcccgatatccgacggtagtgtacctgaggtctgagaatc

SEQ ID NO: 876 - DNA, 70 bp, Artificial Sequence
  Description of Artificial Sequence: Synthetic probe
taatcttgacgaaaatcatgtcccccttcagcttcccgatatccgacggtagtgttacgtgacgtgcaac

SEQ ID NO: 877 - DNA, 70 bp, Artificial Sequence
  Description of Artificial Sequence: Synthetic probe
ctggcgaagcatattcattctttcttcagcttcccgatatccgacggtagtgtggcagtcactgccccag

SEQ ID NO: 878 - DNA, 70 bp, Artificial Sequence
  Description of Artificial Sequence: Synthetic probe
ccatcaccggaacagaaggcttcagcttcccgatatccgacggtagtgtcacaggtgattctaacatgta

SEQ ID NO: 879 - DNA, 70 bp, Artificial Sequence
  Description of Artificial Sequence: Synthetic probe
ctgggattagctgtggccgtacttcagcttcccgatatccgacggtagtgtgtggggtggtggcgttaaa

SEQ ID NO: 880 - DNA, 70 bp, Artificial Sequence
  Description of Artificial Sequence: Synthetic probe
ggtattaggagttggagcccttcagcttcccgatatccgacggtagtgtaatacatagtatttcagatta

SEQ ID NO: 881 - DNA, 70 bp, Artificial Sequence
  Description of Artificial Sequence: Synthetic probe
ctaaaatcctaacccccagtcttcagcttcccgatatccgacggtagtgtgccacctttttaggcttttt

SEQ ID NO: 882 - DNA, 70 bp, Artificial Sequence
  Description of Artificial Sequence: Synthetic probe
ttgttatagactacatgtgtcccttcagcttcccgatatccgacggtagtgttgatccattctaggcaat

SEQ ID NO: 883 - DNA, 70 bp, Artificial Sequence
  Description of Artificial Sequence: Synthetic probe
ttatgagaaaatatgactttaggtcttcagcttcccgatatccgacggtagtgtgtactcacatgggtgg

SEQ ID NO: 884 - DNA, 70 bp, Artificial Sequence
  Description of Artificial Sequence: Synthetic probe
aagtcccaaacataacttcagcttcccgatatccgacggtagtgtcatttgttacttctagacagctaat

SEQ ID NO: 885 - DNA, 70 bp, Artificial Sequence
  Description of Artificial Sequence: Synthetic probe
gttaaagctcatgctaaacctcttcagcttcccgatatccgacggtagtgttattgtggtactaaaaaga

SEQ ID NO: 886 - DNA, 70 bp, Artificial Sequence
  Description of Artificial Sequence: Synthetic probe
atacatagtatttcagattacttcagcttcccgatatccgacggtagtgttgtttaatatgcaattttat

SEQ ID NO: 887 - DNA, 70 bp, Artificial Sequence
  Description of Artificial Sequence: Synthetic probe
gccacctttttaggctttttcttcagcttcccgatatccgacggtagtgtagtgctgtcataatgcaaaa

SEQ ID NO: 888 - DNA, 70 bp, Artificial Sequence
  Description of Artificial Sequence: Synthetic probe
tctgatccattctaggcaatccttcagcttcccgatatccgacggtagtgtagtctgctctataaagagc

SEQ ID NO: 889 - DNA, 70 bp, Artificial Sequence
  Description of Artificial Sequence: Synthetic probe
ctggaagaccacacacgtgcttcagcttcccgatatccgacggtagtgttggagaggcagtaaattatcc

SEQ ID NO: 890 - DNA, 70 bp, Artificial Sequence
  Description of Artificial Sequence: Synthetic probe
gatctcccgtagtgttcttcttcagcttcccgatatccgacggtagtgttcagccatggtgtcacattct

SEQ ID NO: 891 - DNA, 70 bp, Artificial Sequence
  Description of Artificial Sequence: Synthetic probe
gcacttcatctctggcacttcagcttcccgatatccgacggtagtgttcagtcttattttgatgtttact

SEQ ID NO: 892 - DNA, 70 bp, Artificial Sequence
  Description of Artificial Sequence: Synthetic probe
ccatcctgattaatccactcttcagcttcccgatatccgacggtagtgtaaagaaaatctgttttttaaa

SEQ ID NO: 893 - DNA, 70 bp, Artificial Sequence
  Description of Artificial Sequence: Synthetic probe
ttcagaaatatatgaaccatacttcagcttcccgatatccgacggtagtgtcgagcccatctctctgtaa

SEQ ID NO: 894 - DNA, 70 bp, Artificial Sequence
  Description of Artificial Sequence: Synthetic probe
acaaaaacacaatttacactacacttcagcttcccgatatccgacggtagtgtgccagcatggtaagcaa

SEQ ID NO: 895 - DNA, 70 bp, Artificial Sequence
  Description of Artificial Sequence: Synthetic probe
tgagaaacaagaatttttaacacttcagcttcccgatatccgacggtagtgtacttcatctctggcagaa

SEQ ID NO: 896 - DNA, 70 bp, Artificial Sequence
  Description of Artificial Sequence: Synthetic probe
tcatctgccaagaaaccacttcagcttcccgatatccgacggtagtgtagccatcctgattaatccactt

SEQ ID NO: 897 - DNA, 70 bp, Artificial Sequence
  Description of Artificial Sequence: Synthetic probe
ggagaggcagtaaattatccctcttcagcttcccgatatccgacggtagtgttctttaaaaatgttacct

SEQ ID NO: 898 - DNA, 70 bp, Artificial Sequence
  Description of Artificial Sequence: Synthetic probe
cagccatggtgtcacacttcagcttcccgatatccgacggtagtgtgctataaaagattatttctattat

SEQ ID NO: 899 - DNA, 70 bp, Artificial Sequence
  Description of Artificial Sequence: Synthetic probe
gcgagcccatctctctgtcttcagcttcccgatatccgacggtagtgttacatgtgcatgtttggttata

SEQ ID NO: 900 - DNA, 70 bp, Artificial Sequence
  Description of Artificial Sequence: Synthetic probe
gaggccagcatggtaagcacttcagcttcccgatatccgacggtagtgttcaaggtaaaaacagtttgca

SEQ ID NO: 901 - DNA, 70 bp, Artificial Sequence
  Description of Artificial Sequence: Synthetic probe
ctaatatcttaacttggtccacttcagcttcccgatatccgacggtagtgttccaaatgcaattgtagca

SEQ ID NO: 902 - DNA, 70 bp, Artificial Sequence
  Description of Artificial Sequence: Synthetic probe
tttaaaatgcacactacataacacttcagcttcccgatatccgacggtagtgtacgtccggtttgtcaat

SEQ ID NO: 903 - DNA, 70 bp, Artificial Sequence
  Description of Artificial Sequence: Synthetic probe
ccatctcttccagctctgcccttcagcttcccgatatccgacggtagtgtcagaagtaccacaatagcag

SEQ ID NO: 904 - DNA, 70 bp, Artificial Sequence
  Description of Artificial Sequence: Synthetic probe
gaaaagcaggcagtgagatatttcttcagcttcccgatatccgacggtagtgtgattatttaaggaaaac

SEQ ID NO: 905 - DNA, 70 bp, Artificial Sequence
  Description of Artificial Sequence: Synthetic probe
gtctggtcacatcatgacttcagcttcccgatatccgacggtagtgtccaatctgtataaactcctctat

SEQ ID NO: 906 - DNA, 70 bp, Artificial Sequence
  Description of Artificial Sequence: Synthetic probe
ctaaaagctctatcatttcttcagcttcccgatatccgacggtagtgtttagggagagatgcatgaatca

SEQ ID NO: 907 - DNA, 70 bp, Artificial Sequence
  Description of Artificial Sequence: Synthetic probe
aggaacattttcataatagatgccttcagcttcccgatatccgacggtagtgtggtagtaaccctccaca

SEQ ID NO: 908 - DNA, 70 bp, Artificial Sequence
  Description of Artificial Sequence: Synthetic probe
ttagattcataaggcacagacttcttcagcttcccgatatccgacggtagtgttctcttccagctctgcc

SEQ ID NO: 909 - DNA, 70 bp, Artificial Sequence
  Description of Artificial Sequence: Synthetic probe
aacctgatataaaagcttcagcttcccgatatccgacggtagtgtgtatagaaaagcaggcagtgagata

SEQ ID NO: 910 - DNA, 70 bp, Artificial Sequence
  Description of Artificial Sequence: Synthetic probe
ttccaaatgcaattgtagcacttcagcttcccgatatccgacggtagtgtgtctggtcacatcatgatag

SEQ ID NO: 911 - DNA, 70 bp, Artificial Sequence
  Description of Artificial Sequence: Synthetic probe
cgcacgtccggtttgtcttcagcttcccgatatccgacggtagtgtgcccagcttactcattataagtct

SEQ ID NO: 912 - DNA, 70 bp, Artificial Sequence
  Description of Artificial Sequence: Synthetic probe
agggagagatgcatgaatcacttcagcttcccgatatccgacggtagtgtacagaatgtctctacaatgg

SEQ ID NO: 913 - DNA, 70 bp, Artificial Sequence
  Description of Artificial Sequence: Synthetic probe
cttggtagtaaccctccacacttcagcttcccgatatccgacggtagtgtgactactatcatgaggctga

SEQ ID NO: 914 - DNA, 70 bp, Artificial Sequence
  Description of Artificial Sequence: Synthetic probe
agcattgtcaacatggcacttcagcttcccgatatccgacggtagtgttttctcttgtatgatggtttcc

SEQ ID NO: 915 - DNA, 70 bp, Artificial Sequence
  Description of Artificial Sequence: Synthetic probe
attaaataagaaaattactgcttcagcttcccgatatccgacggtagtgtgctatacaaattattgaagt

SEQ ID NO: 916 - DNA, 70 bp, Artificial Sequence
  Description of Artificial Sequence: Synthetic probe
aaatccattttcaccaaagtcttcagcttcccgatatccgacggtagtgtaccaccttttgcaatctaat

SEQ ID NO: 917 - DNA, 70 bp, Artificial Sequence
  Description of Artificial Sequence: Synthetic probe
ggtgtttcttacaaaaatcaggacttcagcttcccgatatccgacggtagtgtttcccctgttaatctgt

SEQ ID NO: 918 - DNA, 70 bp, Artificial Sequence
  Description of Artificial Sequence: Synthetic probe
cagcaattatcacaagaaaccttcagcttcccgatatccgacggtagtgtccaaattactactggaagga

SEQ ID NO: 919 - DNA, 70 bp, Artificial Sequence
  Description of Artificial Sequence: Synthetic probe
agaatagattcatataactttaacttcagcttcccgatatccgacggtagtgttattttcacagtaatgt

SEQ ID NO: 920 - DNA, 70 bp, Artificial Sequence
  Description of Artificial Sequence: Synthetic probe
aatagagcatatcatagaaatcttcagcttcccgatatccgacggtagtgtaaagctgtattctcctgca

SEQ ID NO: 921 - DNA, 70 bp, Artificial Sequence
  Description of Artificial Sequence: Synthetic probe
tagtaagacatacttataggggacttcagcttcccgatatccgacggtagtgttccattttcaccaaagt

SEQ ID NO: 922 - DNA, 70 bp, Artificial Sequence
  Description of Artificial Sequence: Synthetic probe
tttccactaaaagagatgacttcagcttcccgatatccgacggtagtgtgggtgtttcttacaaaaatca

SEQ ID NO: 923 - DNA, 70 bp, Artificial Sequence
  Description of Artificial Sequence: Synthetic probe
tctcttgtatgatggtttcccttcagcttcccgatatccgacggtagtgtcagcaattatcacaagaaac

SEQ ID NO: 924 - DNA, 70 bp, Artificial Sequence
  Description of Artificial Sequence: Synthetic probe
gctatacaaattattgaagtgcttcagcttcccgatatccgacggtagtgtacttctttttttacctttg

SEQ ID NO: 925 - DNA, 70 bp, Artificial Sequence
  Description of Artificial Sequence: Synthetic probe
ttatattttcacagtaatgtcttcagcttcccgatatccgacggtagtgtaaaatttaattataaagaat

SEQ ID NO: 926 - DNA, 70 bp, Artificial Sequence
  Description of Artificial Sequence: Synthetic probe
aaaagctgtattctcctgcacttcagcttcccgatatccgacggtagtgttctacatttttaaagtaaga

SEQ ID NO: 927 - DNA, 70 bp, Artificial Sequence
  Description of Artificial Sequence: Synthetic probe
gaccaaaacctacggaaatttcttcagcttcccgatatccgacggtagtgttcacatcgtcagtcacatc

SEQ ID NO: 928 - DNA, 70 bp, Artificial Sequence
  Description of Artificial Sequence: Synthetic probe
taacccatttccagaccacttcagcttcccgatatccgacggtagtgttgttcttgaacaaatcttacaa

SEQ ID NO: 929 - DNA, 70 bp, Artificial Sequence
  Description of Artificial Sequence: Synthetic probe
gaccagcatattcatagtcttcagcttcccgatatccgacggtagtgttttgttacttaaaagttttatt

SEQ ID NO: 930 - DNA, 70 bp, Artificial Sequence
  Description of Artificial Sequence: Synthetic probe
aatattaactatagtagattcacttcagcttcccgatatccgacggtagtgtctcattccttgtgatgaa

SEQ ID NO: 931 - DNA, 70 bp, Artificial Sequence
  Description of Artificial Sequence: Synthetic probe
aacaatgcctagattactacttcagcttcccgatatccgacggtagtgttccagaaggacctacatgttt

SEQ ID NO: 932 - DNA, 70 bp, Artificial Sequence
  Description of Artificial Sequence: Synthetic probe
gaatactttctgctataacttcagcttcccgatatccgacggtagtgttcgaccagcatattcatagtaa

SEQ ID NO: 933 - DNA, 70 bp, Artificial Sequence
  Description of Artificial Sequence: Synthetic probe
ttttataatcctatgaataaaaagcttcagcttcccgatatccgacggtagtgttgacttacccaagaaa

SEQ ID NO: 934 - DNA, 70 bp, Artificial Sequence
  Description of Artificial Sequence: Synthetic probe
ttcacatcgtcagtcacacttcagcttcccgatatccgacggtagtgtcaattgaagtaactcaaacatt

SEQ ID NO: 935 - DNA, 70 bp, Artificial Sequence
  Description of Artificial Sequence: Synthetic probe
ttcttgaacaaatcttacaacttcagcttcccgatatccgacggtagtgttaaattctttagatgttcaa

SEQ ID NO: 936 - DNA, 70 bp, Artificial Sequence
  Description of Artificial Sequence: Synthetic probe
ttctcattccttgtgatgacttcagcttcccgatatccgacggtagtgtcaaaaagtttttctatgtact

SEQ ID NO: 937 - DNA, 70 bp, Artificial Sequence
  Description of Artificial Sequence: Synthetic probe
ccagaaggacctacatgtcttcagcttcccgatatccgacggtagtgtaaactcaagttttataagaaaa

SEQ ID NO: 938 - DNA, 70 bp, Artificial Sequence
  Description of Artificial Sequence: Synthetic probe
actcatttctgttaaatgagcttcagcttcccgatatccgacggtagtgtggatttttgcactcttactc

SEQ ID NO: 939 - DNA, 70 bp, Artificial Sequence
  Description of Artificial Sequence: Synthetic probe
atagatcacaaaccccggccttcagcttcccgatatccgacggtagtgtagatccttttccaaatatacc

SEQ ID NO: 940 - DNA, 70 bp, Artificial Sequence
  Description of Artificial Sequence: Synthetic probe
tataagtcttcatccaaacttcagcttcccgatatccgacggtagtgtcactatacttcacaataatata

SEQ ID NO: 941 - DNA, 70 bp, Artificial Sequence
  Description of Artificial Sequence: Synthetic probe
gatcgcctggtcattggccttcagcttcccgatatccgacggtagtgtcagtatctataagcttggacaa

SEQ ID NO: 942 - DNA, 70 bp, Artificial Sequence
  Description of Artificial Sequence: Synthetic probe
ctttatttccgagcatcaccttcagcttcccgatatccgacggtagtgtcgtatagaacagtatatataa

SEQ ID NO: 943 - DNA, 70 bp, Artificial Sequence
  Description of Artificial Sequence: Synthetic probe
aaattgccatttagtacacttcagcttcccgatatccgacggtagtgtccaatttaagaaaaacagaata

SEQ ID NO: 944 - DNA, 70 bp, Artificial Sequence
  Description of Artificial Sequence: Synthetic probe
ttatggacaggtttggacagacttcagcttcccgatatccgacggtagtgttcggcattgtgtcgtgaat

SEQ ID NO: 945 - DNA, 70 bp, Artificial Sequence
  Description of Artificial Sequence: Synthetic probe
caaatagaagaggctaaaacttcagcttcccgatatccgacggtagtgttcaagtatcagctttttaaaa

SEQ ID NO: 946 - DNA, 70 bp, Artificial Sequence
  Description of Artificial Sequence: Synthetic probe
gtaaatgtacgtatatcatcacccttcagcttcccgatatccgacggtagtgtaagtcttcatccaaaat

SEQ ID NO: 947 - DNA, 70 bp, Artificial Sequence
  Description of Artificial Sequence: Synthetic probe
taagaagatacaggaagtaagacttcagcttcccgatatccgacggtagtgttcgcctggtcattggcat

SEQ ID NO: 948 - DNA, 70 bp, Artificial Sequence
  Description of Artificial Sequence: Synthetic probe
ggatttttgcactcttactccccttcagcttcccgatatccgacggtagtgtttatttccgagcatcaca

SEQ ID NO: 949 - DNA, 70 bp, Artificial Sequence
  Description of Artificial Sequence: Synthetic probe
gatccttttccaaatatacctgacttcagcttcccgatatccgacggtagtgtttgccatttagtacagt

SEQ ID NO: 950 - DNA, 70 bp, Artificial Sequence
  Description of Artificial Sequence: Synthetic probe
ttcggcattgtgtcgtgcttcagcttcccgatatccgacggtagtgtaaataaacatgaaaaatactata

SEQ ID NO: 951 - DNA, 70 bp, Artificial Sequence
  Description of Artificial Sequence: Synthetic probe
caagtatcagctttttaaacttcagcttcccgatatccgacggtagtgtggttcactcattgtgagataa

SEQ ID NO: 952 - DNA, 70 bp, Artificial Sequence
  Description of Artificial Sequence: Synthetic probe
cactgggaacaggggctcttcagcttcccgatatccgacggtagtgttggaattttctgtttccataaag

SEQ ID NO: 953 - DNA, 70 bp, Artificial Sequence
  Description of Artificial Sequence: Synthetic probe
tattctgtcatgcagatagtcttcagcttcccgatatccgacggtagtgtgctttttgttttttcacact

SEQ ID NO: 954 - DNA, 70 bp, Artificial Sequence
  Description of Artificial Sequence: Synthetic probe
gatttgcagacttctgtaagttcttcagcttcccgatatccgacggtagtgttcacttaaggagttccct

SEQ ID NO: 955 - DNA, 70 bp, Artificial Sequence
  Description of Artificial Sequence: Synthetic probe
atggacaccaaaaactttccccttcagcttcccgatatccgacggtagtgtagaaacaaaccactgagat

SEQ ID NO: 956 - DNA, 70 bp, Artificial Sequence
  Description of Artificial Sequence: Synthetic probe
tgacggtattaaaaatattgacttcagcttcccgatatccgacggtagtgtccccgtctcaaaacaaacc

SEQ ID NO: 957 - DNA, 70 bp, Artificial Sequence
  Description of Artificial Sequence: Synthetic probe
taattgcatttttggggggcttcagcttcccgatatccgacggtagtgtccctctgagacacttttgcta

SEQ ID NO: 958 - DNA, 70 bp, Artificial Sequence
  Description of Artificial Sequence: Synthetic probe
ccatacaggggctttacttcagcttcccgatatccgacggtagtgttctccaagacattttttaaccatc

SEQ ID NO: 959 - DNA, 70 bp, Artificial Sequence
  Description of Artificial Sequence: Synthetic probe
ggagtgggtatatgtgcaccttcagcttcccgatatccgacggtagtgtagatttgcagacttctgtaag

SEQ ID NO: 960 - DNA, 70 bp, Artificial Sequence
  Description of Artificial Sequence: Synthetic probe
ctttatgagagagaaacaaatccttcagcttcccgatatccgacggtagtgtggacaccaaaaactttcc

SEQ ID NO: 961 - DNA, 70 bp, Artificial Sequence
  Description of Artificial Sequence: Synthetic probe
aattttctgtttccataaagtcttcagcttcccgatatccgacggtagtgtgacggtattaaaaatattg

SEQ ID NO: 962 - DNA, 70 bp, Artificial Sequence
  Description of Artificial Sequence: Synthetic probe
gctttttgttttttcacactgccttcagcttcccgatatccgacggtagtgtcccacctgcaagcttctt

SEQ ID NO: 963 - DNA, 70 bp, Artificial Sequence
  Description of Artificial Sequence: Synthetic probe
cctctgagacacttttgctcttcagcttcccgatatccgacggtagtgtgtgccacgtaacaaaggatac

SEQ ID NO: 964 - DNA, 70 bp, Artificial Sequence
  Description of Artificial Sequence: Synthetic probe
caagacattttttaaccatctcttcagcttcccgatatccgacggtagtgtattaactttcggcctatta

SEQ ID NO: 965 - DNA, 70 bp, Artificial Sequence
  Description of Artificial Sequence: Synthetic probe
ccaattttgtaaaaggcacttcagcttcccgatatccgacggtagtgtcctcaggatcagaagataaaga

SEQ ID NO: 966 - DNA, 70 bp, Artificial Sequence
  Description of Artificial Sequence: Synthetic probe
aactgcagggtactgcttcagcttcccgatatccgacggtagtgttcagtaacaccatcaatttgaagca

SEQ ID NO: 967 - DNA, 70 bp, Artificial Sequence
  Description of Artificial Sequence: Synthetic probe
agcacacgtctgctaagtcttcagcttcccgatatccgacggtagtgtaccatatttttccagtttgtct

SEQ ID NO: 968 - DNA, 70 bp, Artificial Sequence
  Description of Artificial Sequence: Synthetic probe
tgaattcaggctcattcacttcagcttcccgatatccgacggtagtgttctgtaatactgaaatcacttc

SEQ ID NO: 969 - DNA, 70 bp, Artificial Sequence
  Description of Artificial Sequence: Synthetic probe
aaattatcacccatagaaaacccttcagcttcccgatatccgacggtagtgtgcgatgtccattcagagt

SEQ ID NO: 970 - DNA, 70 bp, Artificial Sequence
  Description of Artificial Sequence: Synthetic probe
tgcaaaggcataaaattaggaacttcagcttcccgatatccgacggtagtgtacacacatggctgtgtac

SEQ ID NO: 971 - DNA, 70 bp, Artificial Sequence
  Description of Artificial Sequence: Synthetic probe
tcaggatcagaagataaagacttcagcttcccgatatccgacggtagtgtgcttcacattaaacaggctt

SEQ ID NO: 972 - DNA, 70 bp, Artificial Sequence
  Description of Artificial Sequence: Synthetic probe
aacaccatcaatttgaagcacttcagcttcccgatatccgacggtagtgttccttctaattcagtgagac

SEQ ID NO: 973 - DNA, 70 bp, Artificial Sequence
  Description of Artificial Sequence: Synthetic probe
catatttttccagtttgtcttcacttcagcttcccgatatccgacggtagtgtaggaagcattcacacaa

SEQ ID NO: 974 - DNA, 70 bp, Artificial Sequence
  Description of Artificial Sequence: Synthetic probe
tgtaatactgaaatcacttccgccttcagcttcccgatatccgacggtagtgtcttggatgtcagtgtga

SEQ ID NO: 975 - DNA, 70 bp, Artificial Sequence
  Description of Artificial Sequence: Synthetic probe
ctgagcaaagaatccatctccttcagcttcccgatatccgacggtagtgttgttatctgaagatgttttc

SEQ ID NO: 976 - DNA, 70 bp, Artificial Sequence
  Description of Artificial Sequence: Synthetic probe
acaggttacattaattgtatcccttcagcttcccgatatccgacggtagtgttgacacattagttacaga

SEQ ID NO: 977 - DNA, 70 bp, Artificial Sequence
  Description of Artificial Sequence: Synthetic probe
ttgggtagaggttcactgaaggcttcagcttcccgatatccgacggtagtgttacagttggtgtgttttg

SEQ ID NO: 978 - DNA, 70 bp, Artificial Sequence
  Description of Artificial Sequence: Synthetic probe
cttgaccctttgctgatttgtggcttcagcttcccgatatccgacggtagtgtgagagcagtatcccggg

SEQ ID NO: 979 - DNA, 70 bp, Artificial Sequence
  Description of Artificial Sequence: Synthetic probe
ctgctggagcatttttaaagcttcagcttcccgatatccgacggtagtgtctggtgaagaactaaattct

SEQ ID NO: 980 - DNA, 70 bp, Artificial Sequence
  Description of Artificial Sequence: Synthetic probe
gatccacctctctgtgttcttcagcttcccgatatccgacggtagtgtcccaatcattgatggtacttaa

SEQ ID NO: 981 - DNA, 70 bp, Artificial Sequence
  Description of Artificial Sequence: Synthetic probe
caagaaatctggcaataatgcttcagcttcccgatatccgacggtagtgtagtatcaaagtcatccatat

SEQ ID NO: 982 - DNA, 70 bp, Artificial Sequence
  Description of Artificial Sequence: Synthetic probe
tgcatacaacttccttcggcttcagcttcccgatatccgacggtagtgtgtaacaaatgattttgaagtc

SEQ ID NO: 983 - DNA, 70 bp, Artificial Sequence
  Description of Artificial Sequence: Synthetic probe
tttacagttggtgtgttttgggtcttcagcttcccgatatccgacggtagtgtacaaagtgactttgggg

SEQ ID NO: 984 - DNA, 70 bp, Artificial Sequence
  Description of Artificial Sequence: Synthetic probe
cttgagagcagtatcccgggcttcagcttcccgatatccgacggtagtgtttttgatttctgagcagtgc

SEQ ID NO: 985 - DNA, 70 bp, Artificial Sequence
  Description of Artificial Sequence: Synthetic probe
ctggtgaagaactaaacttcagcttcccgatatccgacggtagtgttgtgctttaaaaaagtttctctta

SEQ ID NO: 986 - DNA, 70 bp, Artificial Sequence
  Description of Artificial Sequence: Synthetic probe
caatcattgatggtacttaacttcagcttcccgatatccgacggtagtgtactgtgtttgttgtataaag

SEQ ID NO: 987 - DNA, 70 bp, Artificial Sequence
  Description of Artificial Sequence: Synthetic probe
aaactaattttttaacttcagcttcccgatatccgacggtagtgttctttatttcttaatacaggtgttt

SEQ ID NO: 988 - DNA, 70 bp, Artificial Sequence
  Description of Artificial Sequence: Synthetic probe
agtatcaaagtcatccatatcacttcagcttcccgatatccgacggtagtgtagggtggaggcaaatcag

SEQ ID NO: 989 - DNA, 70 bp, Artificial Sequence
  Description of Artificial Sequence: Synthetic probe
taacaaatgattttgaagtctcagacttcagcttcccgatatccgacggtagtgttctatttgctcgctt

SEQ ID NO: 990 - DNA, 70 bp, Artificial Sequence
  Description of Artificial Sequence: Synthetic probe
cttacaaagtgactttggggtcttcagcttcccgatatccgacggtagtgtctgagtcatccttctgttc

SEQ ID NO: 991 - DNA, 70 bp, Artificial Sequence
  Description of Artificial Sequence: Synthetic probe
ttttgatttctgagcagtgccttcagcttcccgatatccgacggtagtgtgcaaatcacatcgctgctta

SEQ ID NO: 992 - DNA, 70 bp, Artificial Sequence
  Description of Artificial Sequence: Synthetic probe
ctttaaaaaagtttctcttaccctcttcagcttcccgatatccgacggtagtgtagcaatggggccatca

SEQ ID NO: 993 - DNA, 70 bp, Artificial Sequence
  Description of Artificial Sequence: Synthetic probe
actgtgtttgttgtataaagctgcttcagcttcccgatatccgacggtagtgttgagcatcttcatttat

SEQ ID NO: 994 - DNA, 70 bp, Artificial Sequence
  Description of Artificial Sequence: Synthetic probe
ggagggtggaggcaaatcacttcagcttcccgatatccgacggtagtgtccaaatgagttttcagagagt

SEQ ID NO: 995 - DNA, 70 bp, Artificial Sequence
  Description of Artificial Sequence: Synthetic probe
tcaaatctatttgctccttcagcttcccgatatccgacggtagtgtataaaataattgttacctctttca

SEQ ID NO: 996 - DNA, 70 bp, Artificial Sequence
  Description of Artificial Sequence: Synthetic probe
tctgagtcatccttctgtcttcagcttcccgatatccgacggtagtgtacaatgaacatactaaaatgaa

SEQ ID NO: 997 - DNA, 70 bp, Artificial Sequence
  Description of Artificial Sequence: Synthetic probe
gcaaatcacatcgctgcttacttcagcttcccgatatccgacggtagtgttggctagctttgaataaaaa

SEQ ID NO: 998 - DNA, 70 bp, Artificial Sequence
  Description of Artificial Sequence: Synthetic probe
ttttaagaaaccccccaactcttcagcttcccgatatccgacggtagtgtagtcttcggtaacattaaca

SEQ ID NO: 999 - DNA, 70 bp, Artificial Sequence
  Description of Artificial Sequence: Synthetic probe
cttcagcaatggggccacttcagcttcccgatatccgacggtagtgtagctctatatattcatgactatt

SEQ ID NO: 1000 - DNA, 70 bp, Artificial Sequence
  Description of Artificial Sequence: Synthetic probe
tcctgagcatcttcatttacttcagcttcccgatatccgacggtagtgtaccctaacaaccttaaggaca

SEQ ID NO: 1001 - DNA, 70 bp, Artificial Sequence
  Description of Artificial Sequence: Synthetic probe
caaatgagttttcagagagtcactcttcagcttcccgatatccgacggtagtgtttcaaaaagcaccact

SEQ ID NO: 1002 - DNA, 70 bp, Artificial Sequence
  Description of Artificial Sequence: Synthetic probe
ggaaaaactagattagatggacttcagcttcccgatatccgacggtagtgttgggtagaggttcactgaa

SEQ ID NO: 1003 - DNA, 70 bp, Artificial Sequence
  Description of Artificial Sequence: Synthetic probe
aaaagtgaaacctctgaaaaacttcagcttcccgatatccgacggtagtgtttgaccctttgctgatttg

SEQ ID NO: 1004 - DNA, 70 bp, Artificial Sequence
  Description of Artificial Sequence: Synthetic probe
tgttatctgaagatgttttctcttcagcttcccgatatccgacggtagtgttgctggagcatttttaaag

SEQ ID NO: 1005 - DNA, 70 bp, Artificial Sequence
  Description of Artificial Sequence: Synthetic probe
actgacacattagttacagacttcagcttcccgatatccgacggtagtgtgatccacctctctgtgtttc

SEQ ID NO: 1006 - DNA, 70 bp, Artificial Sequence
  Description of Artificial Sequence: Synthetic probe
atttcttaatacaggtgttcttcagcttcccgatatccgacggtagtgtgcaagaaatctggcaataatg

SEQ ID NO: 1007 - DNA, 70 bp, Artificial Sequence
  Description of Artificial Sequence: Synthetic probe
agtcttcggtaacattaacacttcagcttcccgatatccgacggtagtgttgcatacaacttccttcgga

SEQ ID NO: 1008 - DNA, 70 bp, Artificial Sequence
  Description of Artificial Sequence: Synthetic probe
ccatatggattcaacaattcagcacttcagcttcccgatatccgacggtagtgtaggcttatccctgggg

SEQ ID NO: 1009 - DNA, 70 bp, Artificial Sequence
  Description of Artificial Sequence: Synthetic probe
tagcagatacctagctgcttccctcttcagcttcccgatatccgacggtagtgttcttccggggcctctg

SEQ ID NO: 1010 - DNA, 70 bp, Artificial Sequence
  Description of Artificial Sequence: Synthetic probe
tcttcctttcatttctggttttactcttcagcttcccgatatccgacggtagtgtagcaaggcagagctg

SEQ ID NO: 1011 - DNA, 70 bp, Artificial Sequence
  Description of Artificial Sequence: Synthetic probe
ctttgggaggctggcacttcagcttcccgatatccgacggtagtgtatttaataatggcttattttaata

SEQ ID NO: 1012 - DNA, 70 bp, Artificial Sequence
  Description of Artificial Sequence: Synthetic probe
ggaagcagtttttctcctctcttcagcttcccgatatccgacggtagtgtaactgtcattccattagcaa

SEQ ID NO: 1013 - DNA, 70 bp, Artificial Sequence
  Description of Artificial Sequence: Synthetic probe
agagacacgctgcaggggccttcagcttcccgatatccgacggtagtgttatttcctcgtcgagctcctc

SEQ ID NO: 1014 - DNA, 70 bp, Artificial Sequence
  Description of Artificial Sequence: Synthetic probe
gtccacgtgtttttagtgtcttcagcttcccgatatccgacggtagtgtttgcaaagtagtgggaagata

SEQ ID NO: 1015 - DNA, 70 bp, Artificial Sequence
  Description of Artificial Sequence: Synthetic probe
gatgtttacaggtgatgtccttcagcttcccgatatccgacggtagtgtctcttcctttcatttctggtt

SEQ ID NO: 1016 - DNA, 70 bp, Artificial Sequence
  Description of Artificial Sequence: Synthetic probe
tcttcagctacaaatggaaaatgccttcagcttcccgatatccgacggtagtgtgggaggctggcatctt

SEQ ID NO: 1017 - DNA, 70 bp, Artificial Sequence
  Description of Artificial Sequence: Synthetic probe
ggacaggcttatccctggggcttcagcttcccgatatccgacggtagtgtggaagcagtttttctcctct

SEQ ID NO: 1018 - DNA, 70 bp, Artificial Sequence
  Description of Artificial Sequence: Synthetic probe
cacttcttccggggcctctcttcagcttcccgatatccgacggtagtgtacatacccctttgccttggaa

SEQ ID NO: 1019 - DNA, 70 bp, Artificial Sequence
  Description of Artificial Sequence: Synthetic probe
atttcctcgtcgagctcccttcagcttcccgatatccgacggtagtgtccctatattgaaaaagatgtca

SEQ ID NO: 1020 - DNA, 70 bp, Artificial Sequence
  Description of Artificial Sequence: Synthetic probe
tgcaaagtagtgggaagacttcagcttcccgatatccgacggtagtgtcacttttgtcctttcttccctt

SEQ ID NO: 1021 - DNA, 70 bp, Artificial Sequence
  Description of Artificial Sequence: Synthetic probe
ttttctgcctacgagcccccttcagcttcccgatatccgacggtagtgtttggaagatatctttctacat

SEQ ID NO: 1022 - DNA, 70 bp, Artificial Sequence
  Description of Artificial Sequence: Synthetic probe
cctgggcctaatgtgtcctcttcagcttcccgatatccgacggtagtgttccaatgatgctggaggattt

SEQ ID NO: 1023 - DNA, 70 bp, Artificial Sequence
  Description of Artificial Sequence: Synthetic probe
ttcggtggagccataatccttcagcttcccgatatccgacggtagtgtcgagtaaaaacttcaaatggta

SEQ ID NO: 1024 - DNA, 70 bp, Artificial Sequence
  Description of Artificial Sequence: Synthetic probe
cttaagaaacggtctcttcagcttcccgatatccgacggtagtgtccagcatttatttaaatattaatag

SEQ ID NO: 1025 - DNA, 70 bp, Artificial Sequence
  Description of Artificial Sequence: Synthetic probe
ctgcacagagctacaataccacttcagcttcccgatatccgacggtagtgtgaagtatgtgaggctgaac

SEQ ID NO: 1026 - DNA, 70 bp, Artificial Sequence
  Description of Artificial Sequence: Synthetic probe
aaaaatgaatgaccttcctctcttcagcttcccgatatccgacggtagtgtgctattggctcctgatgtc

SEQ ID NO: 1027 - DNA, 70 bp, Artificial Sequence
  Description of Artificial Sequence: Synthetic probe
aaaaatcaaaatgttaaatgaacttcagcttcccgatatccgacggtagtgtcggtggagccataatccc

SEQ ID NO: 1028 - DNA, 70 bp, Artificial Sequence
  Description of Artificial Sequence: Synthetic probe
agaccccctgaaatgtgacttcagcttcccgatatccgacggtagtgtggcttaagaaacggtctattta

SEQ ID NO: 1029 - DNA, 70 bp, Artificial Sequence
  Description of Artificial Sequence: Synthetic probe
tggaagatatctttctacacttcagcttcccgatatccgacggtagtgtggttgttatgagaatgcatat

SEQ ID NO: 1030 - DNA, 70 bp, Artificial Sequence
  Description of Artificial Sequence: Synthetic probe
ccaatgatgctggaggattcttcagcttcccgatatccgacggtagtgtagagggtctatgtacattgag

SEQ ID NO: 1031 - DNA, 70 bp, Artificial Sequence
  Description of Artificial Sequence: Synthetic probe
agaagtatgtgaggctgaactcttcagcttcccgatatccgacggtagtgtggtcagatgctgacaaaca

SEQ ID NO: 1032 - DNA, 70 bp, Artificial Sequence
  Description of Artificial Sequence: Synthetic probe
tgctattggctcctgatgtcttcagcttcccgatatccgacggtagtgtaagaataacagctttatagtc

SEQ ID NO: 1033 - DNA, 70 bp, Artificial Sequence
  Description of Artificial Sequence: Synthetic probe
tccctttacatgctaacttcagcttcccgatatccgacggtagtgtaaattcttcttcttttcgctatta

SEQ ID NO: 1034 - DNA, 70 bp, Artificial Sequence
  Description of Artificial Sequence: Synthetic probe
atcacaccactttgtcttcagcttcccgatatccgacggtagtgtcagttgaatgtaattcagcttcttc

SEQ ID NO: 1035 - DNA, 70 bp, Artificial Sequence
  Description of Artificial Sequence: Synthetic probe
tcttctggagaaggtggaaccttcagcttcccgatatccgacggtagtgtaattgtagaaagcacaaaat

SEQ ID NO: 1036 - DNA, 70 bp, Artificial Sequence
  Description of Artificial Sequence: Synthetic probe
agaggaagaagaagcagaaacttcagcttcccgatatccgacggtagtgttgaggctttcacttgaatgt

SEQ ID NO: 1037 - DNA, 70 bp, Artificial Sequence
  Description of Artificial Sequence: Synthetic probe
gagtgcttctggcaagtcaccttcagcttcccgatatccgacggtagtgtttcaatacatggaactttct

SEQ ID NO: 1038 - DNA, 70 bp, Artificial Sequence
  Description of Artificial Sequence: Synthetic probe
gaacagggcatgagcgattaagacttcagcttcccgatatccgacggtagtgttatcataatcatcatca

SEQ ID NO: 1039 - DNA, 70 bp, Artificial Sequence
  Description of Artificial Sequence: Synthetic probe
ttgttaaccactaatgagacagacttcagcttcccgatatccgacggtagtgttctggagaaggtggaac

SEQ ID NO: 1040 - DNA, 70 bp, Artificial Sequence
  Description of Artificial Sequence: Synthetic probe
agtaaaacagttgataaacacttcagcttcccgatatccgacggtagtgtagaggaagaagaagcagaaa

SEQ ID NO: 1041 - DNA, 70 bp, Artificial Sequence
  Description of Artificial Sequence: Synthetic probe
tcttcttcttttcgctattacttcagcttcccgatatccgacggtagtgtagctagtttacctaaggcat

SEQ ID NO: 1042 - DNA, 70 bp, Artificial Sequence
  Description of Artificial Sequence: Synthetic probe
gaatgtaattcagcttctcttcagcttcccgatatccgacggtagtgtagaaacaaataataatgctaat

SEQ ID NO: 1043 - DNA, 70 bp, Artificial Sequence
  Description of Artificial Sequence: Synthetic probe
ttcaatacatggaactttctcttcagcttcccgatatccgacggtagtgtaattaaacaatttaaagtat

SEQ ID NO: 1044 - DNA, 70 bp, Artificial Sequence
  Description of Artificial Sequence: Synthetic probe
ccgtatcataatcatcacttcagcttcccgatatccgacggtagtgtttttatatagaaatgatattata

SEQ ID NO: 1045 - DNA, 70 bp, Artificial Sequence
  Description of Artificial Sequence: Synthetic probe
agagaagtagttttttaaatttcccttcagcttcccgatatccgacggtagtgttttctgtcagaggtgt

SEQ ID NO: 1046 - DNA, 70 bp, Artificial Sequence
  Description of Artificial Sequence: Synthetic probe
ctgatcagacaatatataacagcttcagcttcccgatatccgacggtagtgttcttttgatgtgctaaga

SEQ ID NO: 1047 - DNA, 70 bp, Artificial Sequence
  Description of Artificial Sequence: Synthetic probe
tgaaacccttaatatcttcagcttcccgatatccgacggtagtgtgcatactcattttctcaggttttga

SEQ ID NO: 1048 - DNA, 70 bp, Artificial Sequence
  Description of Artificial Sequence: Synthetic probe
gctagactcaataaatgtacttcagcttcccgatatccgacggtagtgttggtttctggattcagctcct

SEQ ID NO: 1049 - DNA, 70 bp, Artificial Sequence
  Description of Artificial Sequence: Synthetic probe
aaatgttaagccaatcatactcttcagcttcccgatatccgacggtagtgtgcttgtaccgtcacagtct

SEQ ID NO: 1050 - DNA, 70 bp, Artificial Sequence
  Description of Artificial Sequence: Synthetic probe
tcctttaacgtactgcacttcagcttcccgatatccgacggtagtgtgttgaaatacatggtatgtctaa

SEQ ID NO: 1051 - DNA, 70 bp, Artificial Sequence
  Description of Artificial Sequence: Synthetic probe
ctcttttctgtcagacttcagcttcccgatatccgacggtagtgtgtgttacgttgttttcaaaagtaag

SEQ ID NO: 1052 - DNA, 70 bp, Artificial Sequence
  Description of Artificial Sequence: Synthetic probe
gatcttttgatgtgctaagacttcagcttcccgatatccgacggtagtgtaggttcaaaacacaatcttt

SEQ ID NO: 1053 - DNA, 70 bp, Artificial Sequence
  Description of Artificial Sequence: Synthetic probe
ctcattttctcaggttttgacttcagcttcccgatatccgacggtagtgtctgccattttataacataca

SEQ ID NO: 1054 - DNA, 70 bp, Artificial Sequence
  Description of Artificial Sequence: Synthetic probe
ggtttctggattcagctcccttcagcttcccgatatccgacggtagtgtacattagaagaaaagaaacta

SEQ ID NO: 1055 - DNA, 70 bp, Artificial Sequence
  Description of Artificial Sequence: Synthetic probe
cttaagtccaggagttcaagacccttcagcttcccgatatccgacggtagtgtgctgctgctgtaaactt

SEQ ID NO: 1056 - DNA, 70 bp, Artificial Sequence
  Description of Artificial Sequence: Synthetic probe
tggggaggccaaggcaggacttcagcttcccgatatccgacggtagtgttttacagatgtgctccatcac

SEQ ID NO: 1057 - DNA, 70 bp, Artificial Sequence
  Description of Artificial Sequence: Synthetic probe
atgttccgctgctgaagccttcagcttcccgatatccgacggtagtgtaagtaaacaaatcaaaaacata

SEQ ID NO: 1058 - DNA, 70 bp, Artificial Sequence
  Description of Artificial Sequence: Synthetic probe
gctcatgactgtaatcccagccttcagcttcccgatatccgacggtagtgttcatcaggaatagtatcaa

SEQ ID NO: 1059 - DNA, 70 bp, Artificial Sequence
  Description of Artificial Sequence: Synthetic probe
aaaaaagtcttggctaggcacttcagcttcccgatatccgacggtagtgttcccacaatccaaaagtttc

SEQ ID NO: 1060 - DNA, 70 bp, Artificial Sequence
  Description of Artificial Sequence: Synthetic probe
taatatttttctttgagggaaaaacttcagcttcccgatatccgacggtagtgttccgctgctgaagcag

SEQ ID NO: 1061 - DNA, 70 bp, Artificial Sequence
  Description of Artificial Sequence: Synthetic probe
tctagctataaaataattatgtcttcagcttcccgatatccgacggtagtgtaagggggaaaattaagat

SEQ ID NO: 1062 - DNA, 70 bp, Artificial Sequence
  Description of Artificial Sequence: Synthetic probe
taagctgctgctgtaacttcagcttcccgatatccgacggtagtgtagtggtagaaatataatcagatat

SEQ ID NO: 1063 - DNA, 70 bp, Artificial Sequence
  Description of Artificial Sequence: Synthetic probe
ttacagatgtgctccatcacttcagcttcccgatatccgacggtagtgtgccctgtccatttttcactta

SEQ ID NO: 1064 - DNA, 70 bp, Artificial Sequence
  Description of Artificial Sequence: Synthetic probe
atcatcaggaatagtatcaattcttcagcttcccgatatccgacggtagtgtggccagaaagcctgaaca

SEQ ID NO: 1065 - DNA, 70 bp, Artificial Sequence
  Description of Artificial Sequence: Synthetic probe
tcccacaatccaaaagtttcacttcagcttcccgatatccgacggtagtgttgatgatcatccttatgcc

SEQ ID NO: 1066 - DNA, 70 bp, Artificial Sequence
  Description of Artificial Sequence: Synthetic probe
tcttaaaaacatgaatacgaatgcttcagcttcccgatatccgacggtagtgtctacttccgttagaagt

SEQ ID NO: 1067 - DNA, 70 bp, Artificial Sequence
  Description of Artificial Sequence: Synthetic probe
caaaatatattcgcttttttccccttcagcttcccgatatccgacggtagtgtagactggcatcactttt

SEQ ID NO: 1068 - DNA, 70 bp, Artificial Sequence
  Description of Artificial Sequence: Synthetic probe
gaattccctgtagggcaggcttcagcttcccgatatccgacggtagtgtggacttctgtaaatgggtatt

SEQ ID NO: 1069 - DNA, 70 bp, Artificial Sequence
  Description of Artificial Sequence: Synthetic probe
gtgtgaaaaatttaactccttcacttcagcttcccgatatccgacggtagtgtagcccagttgctactta

SEQ ID NO: 1070 - DNA, 70 bp, Artificial Sequence
  Description of Artificial Sequence: Synthetic probe
caggagaaacagaatttgagggcttcagcttcccgatatccgacggtagtgttttttttttcctagtctt

SEQ ID NO: 1071 - DNA, 70 bp, Artificial Sequence
  Description of Artificial Sequence: Synthetic probe
agggtggtagtcagtaaacacttcagcttcccgatatccgacggtagtgtacatttcctgggaaataaga

SEQ ID NO: 1072 - DNA, 70 bp, Artificial Sequence
  Description of Artificial Sequence: Synthetic probe
ggtggcagagaatcctgtcttcttcagcttcccgatatccgacggtagtgttctttcacagcagtgcttg

SEQ ID NO: 1073 - DNA, 70 bp, Artificial Sequence
  Description of Artificial Sequence: Synthetic probe
aaggcctttcaaaaagattctcttcagcttcccgatatccgacggtagtgttattgaagcagtatgttta

SEQ ID NO: 1074 - DNA, 70 bp, Artificial Sequence
  Description of Artificial Sequence: Synthetic probe
gacttctgtaaatgggtattcttcagcttcccgatatccgacggtagtgtggttgggtttctctttctaa

SEQ ID NO: 1075 - DNA, 70 bp, Artificial Sequence
  Description of Artificial Sequence: Synthetic probe
ttcagcccagttgctcttcagcttcccgatatccgacggtagtgttctatgtcaaaattatcaatatcat

SEQ ID NO: 1076 - DNA, 70 bp, Artificial Sequence
  Description of Artificial Sequence: Synthetic probe
catttttttttcctagtcttggcttcagcttcccgatatccgacggtagtgttcatcatcatcaaagtca

SEQ ID NO: 1077 - DNA, 70 bp, Artificial Sequence
  Description of Artificial Sequence: Synthetic probe
acatttcctgggaaataagagctcttcagcttcccgatatccgacggtagtgtttatgcattatgtcttc

SEQ ID NO: 1078 - DNA, 70 bp, Artificial Sequence
  Description of Artificial Sequence: Synthetic probe
ttttcataccaaatagaaattgcttcagcttcccgatatccgacggtagtgtgcctgtatctccacaatg

SEQ ID NO: 1079 - DNA, 70 bp, Artificial Sequence
  Description of Artificial Sequence: Synthetic probe
atctttcacagcagtgcttgtcttcagcttcccgatatccgacggtagtgtgctgtggaagatttgctgg

SEQ ID NO: 1080 - DNA, 70 bp, Artificial Sequence
  Description of Artificial Sequence: Synthetic probe
ttattgaagcagtatgtttacttcagcttcccgatatccgacggtagtgtgaccttccttgatgggttga

SEQ ID NO: 1081 - DNA, 70 bp, Artificial Sequence
  Description of Artificial Sequence: Synthetic probe
ggttgggtttctctttctcttcagcttcccgatatccgacggtagtgtgtctttctgatactgatttaat

SEQ ID NO: 1082 - DNA, 70 bp, Artificial Sequence
  Description of Artificial Sequence: Synthetic probe
gtcaaaattatcaatatcataggacttcagcttcccgatatccgacggtagtgttctgtcttggctgagg

SEQ ID NO: 1083 - DNA, 70 bp, Artificial Sequence
  Description of Artificial Sequence: Synthetic probe
catcatcatcatcaaagtcatccttcagcttcccgatatccgacggtagtgttgagcagtagatgacact

SEQ ID NO: 1084 - DNA, 70 bp, Artificial Sequence
  Description of Artificial Sequence: Synthetic probe
aaattatgcattatgtcttcccagcttcagcttcccgatatccgacggtagtgtttgactctgagaagtt

SEQ ID NO: 1085 - DNA, 70 bp, Artificial Sequence
  Description of Artificial Sequence: Synthetic probe
agctgtggaagatttgctggcttcagcttcccgatatccgacggtagtgttattttaaacttaccagtat

SEQ ID NO: 1086 - DNA, 70 bp, Artificial Sequence
  Description of Artificial Sequence: Synthetic probe
gaccttccttgatgggtcttcagcttcccgatatccgacggtagtgtagttttgttttcatataagcatt

SEQ ID NO: 1087 - DNA, 70 bp, Artificial Sequence
  Description of Artificial Sequence: Synthetic probe
ctttctgatactgatttaattggccttcagcttcccgatatccgacggtagtgttaattcctattttggg

SEQ ID NO: 1088 - DNA, 70 bp, Artificial Sequence
  Description of Artificial Sequence: Synthetic probe
acagtctgtcttggctgaggaacttcagcttcccgatatccgacggtagtgttgatgatttgctatggtt

SEQ ID NO: 1089 - DNA, 70 bp, Artificial Sequence
  Description of Artificial Sequence: Synthetic probe
gtaggccacaaaagcaaatctgcttcagcttcccgatatccgacggtagtgttccatagggccatcaagt

SEQ ID NO: 1090 - DNA, 70 bp, Artificial Sequence
  Description of Artificial Sequence: Synthetic probe
tttgagcagtagatgacactgcttcagcttcccgatatccgacggtagtgttgcatagcaacaatgtttt

SEQ ID NO: 1091 - DNA, 70 bp, Artificial Sequence
  Description of Artificial Sequence: Synthetic probe
tgaattgactctgagaagtcttcagcttcccgatatccgacggtagtgtttgtaattcatatcatcagta

SEQ ID NO: 1092 - DNA, 70 bp, Artificial Sequence
  Description of Artificial Sequence: Synthetic probe
tattaaatataagtagtttactctgcttcagcttcccgatatccgacggtagtgtccctgtagggcagga

SEQ ID NO: 1093 - DNA, 70 bp, Artificial Sequence
  Description of Artificial Sequence: Synthetic probe
tctgaagagagaaaagagacttcagcttcccgatatccgacggtagtgtggtgtgaaaaatttaactcct

SEQ ID NO: 1094 - DNA, 70 bp, Artificial Sequence
  Description of Artificial Sequence: Synthetic probe
aatctacttccgttagaagtcttcagcttcccgatatccgacggtagtgtcaggagaaacagaatttgag

SEQ ID NO: 1095 - DNA, 70 bp, Artificial Sequence
  Description of Artificial Sequence: Synthetic probe
agaagactggcatcacttttcttcagcttcccgatatccgacggtagtgtagggtggtagtcagtaaaca

SEQ ID NO: 1096 - DNA, 70 bp, Artificial Sequence
  Description of Artificial Sequence: Synthetic probe
aggcctgtatctccacaatgcttcagcttcccgatatccgacggtagtgtggtggcagagaatcctgtct

SEQ ID NO: 1097 - DNA, 70 bp, Artificial Sequence
  Description of Artificial Sequence: Synthetic probe
cctccatagggccatcaagtgaatccttcagcttcccgatatccgacggtagtgtctttcaaaaagattc

SEQ ID NO: 1098 - DNA, 70 bp, Artificial Sequence
  Description of Artificial Sequence: Synthetic probe
cagttcttaaactctttaccttcagcttcccgatatccgacggtagtgtcatgtttcagatttctggatg

SEQ ID NO: 1099 - DNA, 70 bp, Artificial Sequence
  Description of Artificial Sequence: Synthetic probe
cactggcacacgtttccccttcagcttcccgatatccgacggtagtgtaggaaaactaagactttggaaa

SEQ ID NO: 1100 - DNA, 70 bp, Artificial Sequence
  Description of Artificial Sequence: Synthetic probe
cctctagctgattagttctaacttcagcttcccgatatccgacggtagtgttagaaatactgtgtaggtg

SEQ ID NO: 1101 - DNA, 70 bp, Artificial Sequence
  Description of Artificial Sequence: Synthetic probe
tcaccaagcagtgcagcacttcagcttcccgatatccgacggtagtgtacaggaggtttaagaggtccct

SEQ ID NO: 1102 - DNA, 70 bp, Artificial Sequence
  Description of Artificial Sequence: Synthetic probe
tagcatttcccttgccctgcacttcagcttcccgatatccgacggtagtgttcttcatcatttcctttgt

SEQ ID NO: 1103 - DNA, 70 bp, Artificial Sequence
  Description of Artificial Sequence: Synthetic probe
catgaatacagtgaaagtacacttcagcttcccgatatccgacggtagtgttgcaggccaaattttttat

SEQ ID NO: 1104 - DNA, 70 bp, Artificial Sequence
  Description of Artificial Sequence: Synthetic probe
taatcaacgttaagaaaaacttcagcttcccgatatccgacggtagtgtgcctctagctgattagttcta

SEQ ID NO: 1105 - DNA, 70 bp, Artificial Sequence
  Description of Artificial Sequence: Synthetic probe
ttttgtgctgacttgtctaggacttcagcttcccgatatccgacggtagtgtaccaagcagtgcagcatt

SEQ ID NO: 1106 - DNA, 70 bp, Artificial Sequence
  Description of Artificial Sequence: Synthetic probe
atgtttcagatttctggatgctcttcagcttcccgatatccgacggtagtgttcggcatcaggataaaac

SEQ ID NO: 1107 - DNA, 70 bp, Artificial Sequence
  Description of Artificial Sequence: Synthetic probe
gaaaactaagactttggaacttcagcttcccgatatccgacggtagtgtccaattcacttctaaaaatac

SEQ ID NO: 1108 - DNA, 70 bp, Artificial Sequence
  Description of Artificial Sequence: Synthetic probe
atcttcatcatttcctttgtatgcttcagcttcccgatatccgacggtagtgtacatctgccaatggatt

SEQ ID NO: 1109 - DNA, 70 bp, Artificial Sequence
  Description of Artificial Sequence: Synthetic probe
atgcaggccaaatttttcttcagcttcccgatatccgacggtagtgtctttttatttctattaaagagct

SEQ ID NO: 1110 - DNA, 70 bp, Artificial Sequence
  Description of Artificial Sequence: Synthetic probe
tttgccatactcaaatgactcacttcagcttcccgatatccgacggtagtgtgctggtaacacaaactct

SEQ ID NO: 1111 - DNA, 70 bp, Artificial Sequence
  Description of Artificial Sequence: Synthetic probe
ggcatattgtccctggtgccacttcagcttcccgatatccgacggtagtgtgaccccaggagaaacacag

SEQ ID NO: 1112 - DNA, 70 bp, Artificial Sequence
  Description of Artificial Sequence: Synthetic probe
aatcatatcattaataggacaccacttcagcttcccgatatccgacggtagtgttcaagggagaaatgac

SEQ ID NO: 1113 - DNA, 70 bp, Artificial Sequence
  Description of Artificial Sequence: Synthetic probe
gcatgaatgtaaaagttacaaacttcagcttcccgatatccgacggtagtgttttggacttgatctacga

SEQ ID NO: 1114 - DNA, 70 bp, Artificial Sequence
  Description of Artificial Sequence: Synthetic probe
atatctgtcaggttctgtcttcacttcagcttcccgatatccgacggtagtgtaacttacatccaaggaa

SEQ ID NO: 1115 - DNA, 70 bp, Artificial Sequence
  Description of Artificial Sequence: Synthetic probe
cctcctgaaagagaacttcagcttcccgatatccgacggtagtgtgtttctaaggcgtgtttttattagt

SEQ ID NO: 1116 - DNA, 70 bp, Artificial Sequence
  Description of Artificial Sequence: Synthetic probe
gagctggtaacacaaactctcttcagcttcccgatatccgacggtagtgtcagaggactgaaatttaatt

SEQ ID NO: 1117 - DNA, 70 bp, Artificial Sequence
  Description of Artificial Sequence: Synthetic probe
tgaccccaggagaaacacaggccttcagcttcccgatatccgacggtagtgtaactatttaataaaaagg

SEQ ID NO: 1118 - DNA, 70 bp, Artificial Sequence
  Description of Artificial Sequence: Synthetic probe
gatctcaagggagaaatgaccttcagcttcccgatatccgacggtagtgtgctgtgctttattttttaca

SEQ ID NO: 1119 - DNA, 70 bp, Artificial Sequence
  Description of Artificial Sequence: Synthetic probe
cttttggacttgatctaccttcagcttcccgatatccgacggtagtgtgacttctgttcaactgcaaatt

SEQ ID NO: 1120 - DNA, 70 bp, Artificial Sequence
  Description of Artificial Sequence: Synthetic probe
catatctcaacataacaagtcttcagcttcccgatatccgacggtagtgtagtcttatcacctgtcagat

SEQ ID NO: 1121 - DNA, 70 bp, Artificial Sequence
  Description of Artificial Sequence: Synthetic probe
catatcaaacctatcaaaggcttcagcttcccgatatccgacggtagtgtggtaaatatttgtagcttct

SEQ ID NO: 1122 - DNA, 70 bp, Artificial Sequence
  Description of Artificial Sequence: Synthetic probe
ggttttataaatattttattagtcttcagcttcccgatatccgacggtagtgtgggtctttttttgataa

SEQ ID NO: 1123 - DNA, 70 bp, Artificial Sequence
  Description of Artificial Sequence: Synthetic probe
cctgacaaaattacatttgtcttcagcttcccgatatccgacggtagtgttggagtgacatatagaagtt

SEQ ID NO: 1124 - DNA, 70 bp, Artificial Sequence
  Description of Artificial Sequence: Synthetic probe
aaacaatttcaattttatacacttcagcttcccgatatccgacggtagtgtaatgatataaatacaaacc

SEQ ID NO: 1125 - DNA, 70 bp, Artificial Sequence
  Description of Artificial Sequence: Synthetic probe
gctggaatctaagtataacttcagcttcccgatatccgacggtagtgttctagtggtctttaatatattt

SEQ ID NO: 1126 - DNA, 70 bp, Artificial Sequence
  Description of Artificial Sequence: Synthetic probe
agtcttatcacctgtcacttcagcttcccgatatccgacggtagtgttgttaaaatcttaaaaatatatg

SEQ ID NO: 1127 - DNA, 70 bp, Artificial Sequence
  Description of Artificial Sequence: Synthetic probe
ggtaaatatttgtagcttctgcttcagcttcccgatatccgacggtagtgttgcactacgtatacaaaat

SEQ ID NO: 1128 - DNA, 70 bp, Artificial Sequence
  Description of Artificial Sequence: Synthetic probe
attgggtctttttttgataacttcagcttcccgatatccgacggtagtgttggatgaaagttgtacaaaa

SEQ ID NO: 1129 - DNA, 70 bp, Artificial Sequence
  Description of Artificial Sequence: Synthetic probe
tggagtgacatatagaagtcttcagcttcccgatatccgacggtagtgtagtaaaatgttaccatttggg

SEQ ID NO: 1130 - DNA, 70 bp, Artificial Sequence
  Description of Artificial Sequence: Synthetic probe
caattccccccacccacccccttcagcttcccgatatccgacggtagtgtttttccagaggcgacctctg

SEQ ID NO: 1131 - DNA, 70 bp, Artificial Sequence
  Description of Artificial Sequence: Synthetic probe
gacctgctgtgatgtcttcagcttcccgatatccgacggtagtgtctgaaaaaaagtttggagacaacgc

SEQ ID NO: 1132 - DNA, 70 bp, Artificial Sequence
  Description of Artificial Sequence: Synthetic probe
gcctgccgctcaaccctttttcttcagcttcccgatatccgacggtagtgtcggttggccaccttctcac

SEQ ID NO: 1133 - DNA, 70 bp, Artificial Sequence
  Description of Artificial Sequence: Synthetic probe
atgccaaagacctactactctggcttcagcttcccgatatccgacggtagtgttgggcacgtgtctttcc

SEQ ID NO: 1134 - DNA, 70 bp, Artificial Sequence
  Description of Artificial Sequence: Synthetic probe
agggccgtctgggctcaagcttcagcttcccgatatccgacggtagtgtccaacccatacacacgccctc

SEQ ID NO: 1135 - DNA, 70 bp, Artificial Sequence
  Description of Artificial Sequence: Synthetic probe
tctctcgggcgctggggcttcagcttcccgatatccgacggtagtgtaaaactgcttattcctttacccc

SEQ ID NO: 1136 - DNA, 70 bp, Artificial Sequence
  Description of Artificial Sequence: Synthetic probe
ttttccagaggcgacctctgcttcagcttcccgatatccgacggtagtgttgaatgatagcgcatctttt

SEQ ID NO: 1137 - DNA, 70 bp, Artificial Sequence
  Description of Artificial Sequence: Synthetic probe
aaaaagtttggagacaacttcagcttcccgatatccgacggtagtgtacaatacccacattttctttcaa

SEQ ID NO: 1138 - DNA, 70 bp, Artificial Sequence
  Description of Artificial Sequence: Synthetic probe
ccatgatccattacactgtacttcagcttcccgatatccgacggtagtgttgttttgttttgctttctca

SEQ ID NO: 1139 - DNA, 70 bp, Artificial Sequence
  Description of Artificial Sequence: Synthetic probe
acaattagtttgaaaagcacttcagcttcccgatatccgacggtagtgtaccattagaagtttttctatt

SEQ ID NO: 1140 - DNA, 70 bp, Artificial Sequence
  Description of Artificial Sequence: Synthetic probe
tctatcttgaaattaatatctcttcagcttcccgatatccgacggtagtgttgtaagaatttctccaaaa

SEQ ID NO: 1141 - DNA, 70 bp, Artificial Sequence
  Description of Artificial Sequence: Synthetic probe
agcaaccgccaacaactgtcttcagcttcccgatatccgacggtagtgttacacccatacattctcctaa

SEQ ID NO: 1142 - DNA, 70 bp, Artificial Sequence
  Description of Artificial Sequence: Synthetic probe
ttttcaatagatgcttgttttacttcagcttcccgatatccgacggtagtgttactgaagaagaggctgt

SEQ ID NO: 1143 - DNA, 70 bp, Artificial Sequence
  Description of Artificial Sequence: Synthetic probe
aaataaaagatgagtttgtcagcttcagcttcccgatatccgacggtagtgtacaggagtaccaagaagt

SEQ ID NO: 1144 - DNA, 70 bp, Artificial Sequence
  Description of Artificial Sequence: Synthetic probe
acacacacacacacacacttcagcttcccgatatccgacggtagtgtctttctatcttgaaattaatatc

SEQ ID NO: 1145 - DNA, 70 bp, Artificial Sequence
  Description of Artificial Sequence: Synthetic probe
ttccccaaatccctgttaaaacttcagcttcccgatatccgacggtagtgtgcaaccgccaacaactgtc

SEQ ID NO: 1146 - DNA, 70 bp, Artificial Sequence
  Description of Artificial Sequence: Synthetic probe
tgttttgttttgctttctcaaacttcagcttcccgatatccgacggtagtgtaccttgcctgctccagtg

SEQ ID NO: 1147 - DNA, 70 bp, Artificial Sequence
  Description of Artificial Sequence: Synthetic probe
ccattagaagtttttctcttcagcttcccgatatccgacggtagtgtaagttcttaatagtgaagaacaa

SEQ ID NO: 1148 - DNA, 70 bp, Artificial Sequence
  Description of Artificial Sequence: Synthetic probe
attactgaagaagaggctgtcacttcagcttcccgatatccgacggtagtgtagagacatggacaccaaa

SEQ ID NO: 1149 - DNA, 70 bp, Artificial Sequence
  Description of Artificial Sequence: Synthetic probe
ggacaggagtaccaagaagtgcttcagcttcccgatatccgacggtagtgttccagcactacaaactaga

SEQ ID NO: 1150 - DNA, 70 bp, Artificial Sequence
  Description of Artificial Sequence: Synthetic probe
aaatatttaaaatacttcctgtcttcagcttcccgatatccgacggtagtgtatcaccattagaagtgaa

SEQ ID NO: 1151 - DNA, 70 bp, Artificial Sequence
  Description of Artificial Sequence: Synthetic probe
agattctattaactcatttgacttcagcttcccgatatccgacggtagtgtcctctgaaggctccagttc

SEQ ID NO: 1152 - DNA, 70 bp, Artificial Sequence
  Description of Artificial Sequence: Synthetic probe
ttttctttaatggtgccaggcttcagcttcccgatatccgacggtagtgtgaatatggagccaaatatat

SEQ ID NO: 1153 - DNA, 70 bp, Artificial Sequence
  Description of Artificial Sequence: Synthetic probe
atcataggaaacaccacttcagcttcccgatatccgacggtagtgtaaacataaatatatgtagactaac

SEQ ID NO: 1154 - DNA, 70 bp, Artificial Sequence
  Description of Artificial Sequence: Synthetic probe
tgatgacgcttctgtatctcttcagcttcccgatatccgacggtagtgtcacagtagcttacccatagag

SEQ ID NO: 1155 - DNA, 70 bp, Artificial Sequence
  Description of Artificial Sequence: Synthetic probe
cagaagtgtatattcttatttgtcttcagcttcccgatatccgacggtagtgttcttccactgtgcttaa

SEQ ID NO: 1156 - DNA, 70 bp, Artificial Sequence
  Description of Artificial Sequence: Synthetic probe
acttgcctccaattatcatcccttcagcttcccgatatccgacggtagtgtccaggaaaactgagaacag

SEQ ID NO: 1157 - DNA, 70 bp, Artificial Sequence
  Description of Artificial Sequence: Synthetic probe
cattatcaaatcacgctcaggacttcagcttcccgatatccgacggtagtgtttctttaatggtgccagg

SEQ ID NO: 1158 - DNA, 70 bp, Artificial Sequence
  Description of Artificial Sequence: Synthetic probe
gaaataaaacccatcattattaggtcttcagcttcccgatatccgacggtagtgtaggaaacaccaaaga

SEQ ID NO: 1159 - DNA, 70 bp, Artificial Sequence
  Description of Artificial Sequence: Synthetic probe
taatcaccattagaacttcagcttcccgatatccgacggtagtgttgctttgatgacgcttctgtatcta

SEQ ID NO: 1160 - DNA, 70 bp, Artificial Sequence
  Description of Artificial Sequence: Synthetic probe
ccctctgaaggctccagttcttcagcttcccgatatccgacggtagtgttcttacctcttctagttggca

SEQ ID NO: 1161 - DNA, 70 bp, Artificial Sequence
  Description of Artificial Sequence: Synthetic probe
aattcttccactgtgctcttcagcttcccgatatccgacggtagtgtgcataatcaaaaagttttcacat

SEQ ID NO: 1162 - DNA, 70 bp, Artificial Sequence
  Description of Artificial Sequence: Synthetic probe
tccaggaaaactgagaacagcttcagcttcccgatatccgacggtagtgtgggtagtgtgaagggttcat

SEQ ID NO: 1163 - DNA, 70 bp, Artificial Sequence
  Description of Artificial Sequence: Synthetic probe
tttgaacattgcatctccattcttcagcttcccgatatccgacggtagtgtttgtctttctctgcaaact

SEQ ID NO: 1164 - DNA, 70 bp, Artificial Sequence
  Description of Artificial Sequence: Synthetic probe
ctattgctttaaccacagttgaacttcagcttcccgatatccgacggtagtgtttccaccttctccaaga

SEQ ID NO: 1165 - DNA, 70 bp, Artificial Sequence
  Description of Artificial Sequence: Synthetic probe
ccttctaatgtaatcatatatcacacttcagcttcccgatatccgacggtagtgttcgttgacctccact

SEQ ID NO: 1166 - DNA, 70 bp, Artificial Sequence
  Description of Artificial Sequence: Synthetic probe
aatctgaatttgaaaggcacacttcagcttcccgatatccgacggtagtgtgttattcaccttgctaaag

SEQ ID NO: 1167 - DNA, 70 bp, Artificial Sequence
  Description of Artificial Sequence: Synthetic probe
ttagagagtcacttttagtatgctccttcagcttcccgatatccgacggtagtgttgcttgctagaccaa

SEQ ID NO: 1168 - DNA, 70 bp, Artificial Sequence
  Description of Artificial Sequence: Synthetic probe
atgtcctattaccaaaaatagcttcagcttcccgatatccgacggtagtgtttttttacatgaatgacat

SEQ ID NO: 1169 - DNA, 70 bp, Artificial Sequence
  Description of Artificial Sequence: Synthetic probe
attgtctttctctgcaaactcttcagcttcccgatatccgacggtagtgttaaagcaatagagaaatgtc

SEQ ID NO: 1170 - DNA, 70 bp, Artificial Sequence
  Description of Artificial Sequence: Synthetic probe
tgattccaccttctccaagacttcagcttcccgatatccgacggtagtgtttttttcaattccagaaaca

SEQ ID NO: 1171 - DNA, 70 bp, Artificial Sequence
  Description of Artificial Sequence: Synthetic probe
cttgctcgttgacctccactcttcagcttcccgatatccgacggtagtgtacccactagccataaaaccc

SEQ ID NO: 1172 - DNA, 70 bp, Artificial Sequence
  Description of Artificial Sequence: Synthetic probe
actattctcaaaagtggtgcacttcagcttcccgatatccgacggtagtgttcagcatctttgtatactg

SEQ ID NO: 1173 - DNA, 70 bp, Artificial Sequence
  Description of Artificial Sequence: Synthetic probe
caccacatcgattcactgaacttcagcttcccgatatccgacggtagtgtcaaaaggagagtctaataaa

SEQ ID NO: 1174 - DNA, 70 bp, Artificial Sequence
  Description of Artificial Sequence: Synthetic probe
ttcactacatgcattacacttcagcttcccgatatccgacggtagtgtctttttctgttaaaacatctag

SEQ ID NO: 1175 - DNA, 70 bp, Artificial Sequence
  Description of Artificial Sequence: Synthetic probe
agtgtagatgatttgcctcttcagcttcccgatatccgacggtagtgtcaaagaacatacctttcaaata

SEQ ID NO: 1176 - DNA, 70 bp, Artificial Sequence
  Description of Artificial Sequence: Synthetic probe
tttcctctctatttcctggtccttcagcttcccgatatccgacggtagtgttgagcattataagtaaggt

SEQ ID NO: 1177 - DNA, 70 bp, Artificial Sequence
  Description of Artificial Sequence: Synthetic probe
aaaagaaaatggaaattaaacttcagcttcccgatatccgacggtagtgtcagtctgtctttcttttatt

SEQ ID NO: 1178 - DNA, 70 bp, Artificial Sequence
  Description of Artificial Sequence: Synthetic probe
atcagcatctttgtatacttcagcttcccgatatccgacggtagtgtaagaggtaaaatgcaatctatga

SEQ ID NO: 1179 - DNA, 70 bp, Artificial Sequence
  Description of Artificial Sequence: Synthetic probe
caaaaggagagtctaatacttcagcttcccgatatccgacggtagtgtccaacaatggtgaacatatttc

SEQ ID NO: 1180 - DNA, 70 bp, Artificial Sequence
  Description of Artificial Sequence: Synthetic probe
ttttctgttaaaacatctagcttcagcttcccgatatccgacggtagtgtataccatgctacattctgcc

SEQ ID NO: 1181 - DNA, 70 bp, Artificial Sequence
  Description of Artificial Sequence: Synthetic probe
ttatattttaaatgattctcttcagcttcccgatatccgacggtagtgttcctagttttgttagccatca

SEQ ID NO: 1182 - DNA, 70 bp, Artificial Sequence
  Description of Artificial Sequence: Synthetic probe
atataatctctatcatacaattcttcagcttcccgatatccgacggtagtgttccattttagaagtgacc

SEQ ID NO: 1183 - DNA, 70 bp, Artificial Sequence
  Description of Artificial Sequence: Synthetic probe
ggagttctgaaaatgtcccacttcagcttcccgatatccgacggtagtgttttttgtttctgtccaggag

SEQ ID NO: 1184 - DNA, 70 bp, Artificial Sequence
  Description of Artificial Sequence: Synthetic probe
gagctaaagtctggctgtacttcagcttcccgatatccgacggtagtgtctctccagtctgtttaaaaga

SEQ ID NO: 1185 - DNA, 70 bp, Artificial Sequence
  Description of Artificial Sequence: Synthetic probe
gaaagaatcacatcccatgacttcagcttcccgatatccgacggtagtgtagaattcttccttttttccc

SEQ ID NO: 1186 - DNA, 70 bp, Artificial Sequence
  Description of Artificial Sequence: Synthetic probe
ttcttctttctgcaccttcagcttcccgatatccgacggtagtgtttttcgtatagagttgattggattg

SEQ ID NO: 1187 - DNA, 70 bp, Artificial Sequence
  Description of Artificial Sequence: Synthetic probe
tgtaaggtctcagttaggacttcagcttcccgatatccgacggtagtgtagtcttttgcacaatggaaaa

SEQ ID NO: 1188 - DNA, 70 bp, Artificial Sequence
  Description of Artificial Sequence: Synthetic probe
agcatctccttctaatgagaacttcagcttcccgatatccgacggtagtgttcgatgccattcatttgta

SEQ ID NO: 1189 - DNA, 70 bp, Artificial Sequence
  Description of Artificial Sequence: Synthetic probe
tttttgtttctgtccaggagcttcagcttcccgatatccgacggtagtgttctctaaaggctcatcagaa

SEQ ID NO: 1190 - DNA, 70 bp, Artificial Sequence
  Description of Artificial Sequence: Synthetic probe
tctccagtctgtttaaaagattgcttcagcttcccgatatccgacggtagtgttctggtactaaggacag

SEQ ID NO: 1191 - DNA, 70 bp, Artificial Sequence
  Description of Artificial Sequence: Synthetic probe
agaattcttccttttttccccacttcagcttcccgatatccgacggtagtgtgcagtatcgcctctccct

SEQ ID NO: 1192 - DNA, 70 bp, Artificial Sequence
  Description of Artificial Sequence: Synthetic probe
gtatagagttgattggattcttcagcttcccgatatccgacggtagtgtgggccagtgctgatcacgctg

SEQ ID NO: 1193 - DNA, 70 bp, Artificial Sequence
  Description of Artificial Sequence: Synthetic probe
tagcattttgttaatgttttattgccttcagcttcccgatatccgacggtagtgttttgtcagctttctt

SEQ ID NO: 1194 - DNA, 70 bp, Artificial Sequence
  Description of Artificial Sequence: Synthetic probe
gtcttttgcacaatggaaaattcttcagcttcccgatatccgacggtagtgtcctccttcgtgcctgaag

SEQ ID NO: 1195 - DNA, 70 bp, Artificial Sequence
  Description of Artificial Sequence: Synthetic probe
ttcgatgccattcatttgtaaggcttcagcttcccgatatccgacggtagtgttgtcatcaggttcagga

SEQ ID NO: 1196 - DNA, 70 bp, Artificial Sequence
  Description of Artificial Sequence: Synthetic probe
tctctaaaggctcatcagaatcccttcagcttcccgatatccgacggtagtgttgttctgaccttggtta

SEQ ID NO: 1197 - DNA, 70 bp, Artificial Sequence
  Description of Artificial Sequence: Synthetic probe
gaatctggtactaaggacagcccttcagcttcccgatatccgacggtagtgttgtggatgctgttgtctt

SEQ ID NO: 1198 - DNA, 70 bp, Artificial Sequence
  Description of Artificial Sequence: Synthetic probe
aggcagtatcgcctctccctgccttcagcttcccgatatccgacggtagtgtcctgaggggccagtgaca

SEQ ID NO: 1199 - DNA, 70 bp, Artificial Sequence
  Description of Artificial Sequence: Synthetic probe
ggccagtgctgatcacgctgatgcgcttcagcttcccgatatccgacggtagtgtatatccagttcagtc

SEQ ID NO: 1200 - DNA, 70 bp, Artificial Sequence
  Description of Artificial Sequence: Synthetic probe
tgcctccttcgtgcctgacttcagcttcccgatatccgacggtagtgtagccagtttcttgagataacct

SEQ ID NO: 1201 - DNA, 70 bp, Artificial Sequence
  Description of Artificial Sequence: Synthetic probe
gtgtgtcatcaggttcaggcttcagcttcccgatatccgacggtagtgtcgttaatttcttcacttattt

SEQ ID NO: 1202 - DNA, 70 bp, Artificial Sequence
  Description of Artificial Sequence: Synthetic probe
gaatgttctgaccttggttcttcagcttcccgatatccgacggtagtgttgtatacctacctttaagtct

SEQ ID NO: 1203 - DNA, 70 bp, Artificial Sequence
  Description of Artificial Sequence: Synthetic probe
cgtgtggatgctgttgtcttcttcagcttcccgatatccgacggtagtgtgtggggtgaaatacccccaa

SEQ ID NO: 1204 - DNA, 70 bp, Artificial Sequence
  Description of Artificial Sequence: Synthetic probe
ctttattgcaatatgtctcgtacttcagcttcccgatatccgacggtagtgtagctgctaccttcatgca

SEQ ID NO: 1205 - DNA, 70 bp, Artificial Sequence
  Description of Artificial Sequence: Synthetic probe
tgcctgaggggccagtcttcagcttcccgatatccgacggtagtgtacatattgcattctactcaattgc

SEQ ID NO: 1206 - DNA, 70 bp, Artificial Sequence
  Description of Artificial Sequence: Synthetic probe
aatatatatccagttcagtcacttcagcttcccgatatccgacggtagtgtagtaaattttgttacatgc

SEQ ID NO: 1207 - DNA, 70 bp, Artificial Sequence
  Description of Artificial Sequence: Synthetic probe
ccagtttcttgagataacctcttcagcttcccgatatccgacggtagtgtacaccttatcctaatcctat

SEQ ID NO: 1208 - DNA, 70 bp, Artificial Sequence
  Description of Artificial Sequence: Synthetic probe
gttaatttcttcacttatttcccttcagcttcccgatatccgacggtagtgttcatactttctgagtttt

SEQ ID NO: 1209 - DNA, 70 bp, Artificial Sequence
  Description of Artificial Sequence: Synthetic probe
catataaatatcaattttataaacttcagcttcccgatatccgacggtagtgtgttctgaaaatgtccca

SEQ ID NO: 1210 - DNA, 70 bp, Artificial Sequence
  Description of Artificial Sequence: Synthetic probe
cagacacagctttaagatacttcagcttcccgatatccgacggtagtgttgagctaaagtctggctgtag

SEQ ID NO: 1211 - DNA, 70 bp, Artificial Sequence
  Description of Artificial Sequence: Synthetic probe
cctagttttgttagccatccttcagcttcccgatatccgacggtagtgtcgaaagaatcacatcccatga

SEQ ID NO: 1212 - DNA, 70 bp, Artificial Sequence
  Description of Artificial Sequence: Synthetic probe
gttccattttagaagtgaccacttcagcttcccgatatccgacggtagtgttcttctttctgcactaaat

SEQ ID NO: 1213 - DNA, 70 bp, Artificial Sequence
  Description of Artificial Sequence: Synthetic probe
aatattttgtcagctttcttcttcagcttcccgatatccgacggtagtgttgtaaggtctcagttaggat

SEQ ID NO: 1214 - DNA, 70 bp, Artificial Sequence
  Description of Artificial Sequence: Synthetic probe
atagctgctaccttcatgcacttcagcttcccgatatccgacggtagtgtagcatctccttctaatgaga

SEQ ID NO: 1215 - DNA, 70 bp, Artificial Sequence
  Description of Artificial Sequence: Synthetic probe
agtgtattttaacaaatataaacttcagcttcccgatatccgacggtagtgttcactgctggtatgctct

SEQ ID NO: 1216 - DNA, 70 bp, Artificial Sequence
  Description of Artificial Sequence: Synthetic probe
aaaagaatagtattacttgaatctcttcagcttcccgatatccgacggtagtgttcgaaggtatgtgttc

SEQ ID NO: 1217 - DNA, 70 bp, Artificial Sequence
  Description of Artificial Sequence: Synthetic probe
ggttttatttttaatatatgaaaacttcagcttcccgatatccgacggtagtgtttaagctcttgtggac

SEQ ID NO: 1218 - DNA, 70 bp, Artificial Sequence
  Description of Artificial Sequence: Synthetic probe
cagtacagtttcatgccaccattgcttcagcttcccgatatccgacggtagtgtactaagcaccaaatta

SEQ ID NO: 1219 - DNA, 70 bp, Artificial Sequence
  Description of Artificial Sequence: Synthetic probe
aagaattatggctattacaacttcagcttcccgatatccgacggtagtgtagaacattcttacctctgcc

SEQ ID NO: 1220 - DNA, 70 bp, Artificial Sequence
  Description of Artificial Sequence: Synthetic probe
tcatcaaaaaagcactcccttcagcttcccgatatccgacggtagtgtactttaaatccagtaatacttt

SEQ ID NO: 1221 - DNA, 70 bp, Artificial Sequence
  Description of Artificial Sequence: Synthetic probe
agtcactgctggtatgctccttcagcttcccgatatccgacggtagtgtacatccccaaactatcttaat

SEQ ID NO: 1222 - DNA, 70 bp, Artificial Sequence
  Description of Artificial Sequence: Synthetic probe
tatatcgaaggtatgtgttccacttcagcttcccgatatccgacggtagtgtatgtgtgtgcatatatat

SEQ ID NO: 1223 - DNA, 70 bp, Artificial Sequence
  Description of Artificial Sequence: Synthetic probe
aaaattaagctcttgtggaccttcagcttcccgatatccgacggtagtgttgtatacatgtgtatatata

SEQ ID NO: 1224 - DNA, 70 bp, Artificial Sequence
  Description of Artificial Sequence: Synthetic probe
aattactaagcaccaaattcttcagcttcccgatatccgacggtagtgttgtgtgtatatatgcatactt

SEQ ID NO: 1225 - DNA, 70 bp, Artificial Sequence
  Description of Artificial Sequence: Synthetic probe
cctttgctttgtgttcctgggcttcagcttcccgatatccgacggtagtgtacaaccaaagaagcagcca

SEQ ID NO: 1226 - DNA, 70 bp, Artificial Sequence
  Description of Artificial Sequence: Synthetic probe
atcaaggtacacacaatttcacttcagcttcccgatatccgacggtagtgttactcactttccaaggagc

SEQ ID NO: 1227 - DNA, 70 bp, Artificial Sequence
  Description of Artificial Sequence: Synthetic probe
cacaccatttgatgtgtgtcttcagcttcccgatatccgacggtagtgtacacaatctacacaataggac

SEQ ID NO: 1228 - DNA, 70 bp, Artificial Sequence
  Description of Artificial Sequence: Synthetic probe
cccatgcccacatctaacttcagcttcccgatatccgacggtagtgtttacaatatttaatcaacagaaa

SEQ ID NO: 1229 - DNA, 70 bp, Artificial Sequence
  Description of Artificial Sequence: Synthetic probe
ttttctaacatcttcacctcttcagcttcccgatatccgacggtagtgtacaatacatacaaacatagtg

SEQ ID NO: 1230 - DNA, 70 bp, Artificial Sequence
  Description of Artificial Sequence: Synthetic probe
aatggaacaagacacagttgcttcagcttcccgatatccgacggtagtgtgggagaaatgaaacaaagtg

SEQ ID NO: 1231 - DNA, 70 bp, Artificial Sequence
  Description of Artificial Sequence: Synthetic probe
cacaaccaaagaagcagccttcagcttcccgatatccgacggtagtgtccttatctttccactaccataa

SEQ ID NO: 1232 - DNA, 70 bp, Artificial Sequence
  Description of Artificial Sequence: Synthetic probe
gagcatgcacccttaacctcttcagcttcccgatatccgacggtagtgtactatgagtactattcccttt

SEQ ID NO: 1233 - DNA, 70 bp, Artificial Sequence
  Description of Artificial Sequence: Synthetic probe
ataaatacaatattttgcattagcttcagcttcccgatatccgacggtagtgtcactgcatagctgttat

SEQ ID NO: 1234 - DNA, 70 bp, Artificial Sequence
  Description of Artificial Sequence: Synthetic probe
gaatcccatagcaagcaaagtcttcagcttcccgatatccgacggtagtgttcagcagtttcatttctta

SEQ ID NO: 1235 - DNA, 70 bp, Artificial Sequence
  Description of Artificial Sequence: Synthetic probe
tatgcaccagtggtagacctctcttcagcttcccgatatccgacggtagtgtaccacaggccctattgat

SEQ ID NO: 1236 - DNA, 70 bp, Artificial Sequence
  Description of Artificial Sequence: Synthetic probe
aaaattttcgacactgtgacttcagcttcccgatatccgacggtagtgtccagcactgccattagaaaac

SEQ ID NO: 1237 - DNA, 70 bp, Artificial Sequence
  Description of Artificial Sequence: Synthetic probe
aacagaatgtaacattttgtggtgcttcagcttcccgatatccgacggtagtgtcacatgcctctgtgca

SEQ ID NO: 1238 - DNA, 70 bp, Artificial Sequence
  Description of Artificial Sequence: Synthetic probe
tgagggttgacataggtgctcttcagcttcccgatatccgacggtagtgttgccagtcaaatggaggttc

SEQ ID NO: 1239 - DNA, 70 bp, Artificial Sequence
  Description of Artificial Sequence: Synthetic probe
taaatggaactaaacttgagtctcttcagcttcccgatatccgacggtagtgtaatacgaactggtgctg

SEQ ID NO: 1240 - DNA, 70 bp, Artificial Sequence
  Description of Artificial Sequence: Synthetic probe
ttacttactgaatttccaatacacttcagcttcccgatatccgacggtagtgtactcccacgtaaatgta

SEQ ID NO: 1241 - DNA, 70 bp, Artificial Sequence
  Description of Artificial Sequence: Synthetic probe
ggaaatcgttatttggcagccaacttcagcttcccgatatccgacggtagtgttcccatagcaagcaaag

SEQ ID NO: 1242 - DNA, 70 bp, Artificial Sequence
  Description of Artificial Sequence: Synthetic probe
gaagaggagtgctgtaaagcaacttcagcttcccgatatccgacggtagtgttgcaccagtggtagacct

SEQ ID NO: 1243 - DNA, 70 bp, Artificial Sequence
  Description of Artificial Sequence: Synthetic probe
ctatgagtactattccctttgtctcttcagcttcccgatatccgacggtagtgtttttcgacactgtgat

SEQ ID NO: 1244 - DNA, 70 bp, Artificial Sequence
  Description of Artificial Sequence: Synthetic probe
aatcactgcatagctgttcttcagcttcccgatatccgacggtagtgtagaacagaatgtaacattttgt

SEQ ID NO: 1245 - DNA, 70 bp, Artificial Sequence
  Description of Artificial Sequence: Synthetic probe
cataatacgaactggtgcttcagcttcccgatatccgacggtagtgttgttgagggttgacataggtgct

SEQ ID NO: 1246 - DNA, 70 bp, Artificial Sequence
  Description of Artificial Sequence: Synthetic probe
gctactcccacgtaaatgtcttcagcttcccgatatccgacggtagtgttagtaaagtacctgctttcaa

SEQ ID NO: 1247 - DNA, 70 bp, Artificial Sequence
  Description of Artificial Sequence: Synthetic probe
atcagatagacttagaaattcttcagcttcccgatatccgacggtagtgttggagaatctattaagaatc

SEQ ID NO: 1248 - DNA, 70 bp, Artificial Sequence
  Description of Artificial Sequence: Synthetic probe
acccaaataagaattagcaacttcagcttcccgatatccgacggtagtgtaggtcatccaaaattgctat

SEQ ID NO: 1249 - DNA, 70 bp, Artificial Sequence
  Description of Artificial Sequence: Synthetic probe
ttggatcacagtagacttcagcttcccgatatccgacggtagtgttggatgaagtcaaatatggtaagag

SEQ ID NO: 1250 - DNA, 70 bp, Artificial Sequence
  Description of Artificial Sequence: Synthetic probe
tatatcaatatattcaatacttcagcttcccgatatccgacggtagtgtcggtacttatttttacatacc

SEQ ID NO: 1251 - DNA, 70 bp, Artificial Sequence
  Description of Artificial Sequence: Synthetic probe
tcaaaaaacactaattttttcttcagcttcccgatatccgacggtagtgtttttaataatacagacatac

SEQ ID NO: 1252 - DNA, 70 bp, Artificial Sequence
  Description of Artificial Sequence: Synthetic probe
tataatatacaagatgacaaacttcagcttcccgatatccgacggtagtgttcacatttgcttttgttat

SEQ ID NO: 1253 - DNA, 70 bp, Artificial Sequence
  Description of Artificial Sequence: Synthetic probe
tggagaatctattaagacttcagcttcccgatatccgacggtagtgtcctcaatcaaataaaaaatgaaa

SEQ ID NO: 1254 - DNA, 70 bp, Artificial Sequence
  Description of Artificial Sequence: Synthetic probe
aggtcatccaaaattgctatacttcagcttcccgatatccgacggtagtgttgcaatagacaggacttca

SEQ ID NO: 1255 - DNA, 70 bp, Artificial Sequence
  Description of Artificial Sequence: Synthetic probe
gaagtcaaatatggtaagaggccttcagcttcccgatatccgacggtagtgtggctttggataattacaa

SEQ ID NO: 1256 - DNA, 70 bp, Artificial Sequence
  Description of Artificial Sequence: Synthetic probe
caaacttttttttattttttttcttcagcttcccgatatccgacggtagtgtgcgacaactgctatagct

SEQ ID NO: 1257 - DNA, 70 bp, Artificial Sequence
  Description of Artificial Sequence: Synthetic probe
ttttttttgcatactttaaacaccttcagcttcccgatatccgacggtagtgtacaaagatgtagggttg

SEQ ID NO: 1258 - DNA, 70 bp, Artificial Sequence
  Description of Artificial Sequence: Synthetic probe
agttgtttgagttgctgtcttcagcttcccgatatccgacggtagtgtacatgcatgtagaaaaaaatta

SEQ ID NO: 1259 - DNA, 70 bp, Artificial Sequence
  Description of Artificial Sequence: Synthetic probe
gtgtgtcagtgatttatttctttcttcagcttcccgatatccgacggtagtgtagccactatcactggca

SEQ ID NO: 1260 - DNA, 70 bp, Artificial Sequence
  Description of Artificial Sequence: Synthetic probe
attttcacattgcaaagtggcttcagcttcccgatatccgacggtagtgtggaggaaatatgctctcaac

SEQ ID NO: 1261 - DNA, 70 bp, Artificial Sequence
  Description of Artificial Sequence: Synthetic probe
aaagaaaacatgttggtgagtcttcagcttcccgatatccgacggtagtgtgttgtttgagttgctgtga

SEQ ID NO: 1262 - DNA, 70 bp, Artificial Sequence
  Description of Artificial Sequence: Synthetic probe
cacaattaataacaactgtaagcttcagcttcccgatatccgacggtagtgttcactgtcataccttcag

SEQ ID NO: 1263 - DNA, 70 bp, Artificial Sequence
  Description of Artificial Sequence: Synthetic probe
ctgcgacaactgctatagccttcagcttcccgatatccgacggtagtgtgcttttttacaagatgagtat

SEQ ID NO: 1264 - DNA, 70 bp, Artificial Sequence
  Description of Artificial Sequence: Synthetic probe
gcaacaaagatgtagggttgtcttcagcttcccgatatccgacggtagtgtaagaatctcaaatagctct

SEQ ID NO: 1265 - DNA, 70 bp, Artificial Sequence
  Description of Artificial Sequence: Synthetic probe
aaaagccactatcactggccttcagcttcccgatatccgacggtagtgtgaattttttttaagtagatta

SEQ ID NO: 1266 - DNA, 70 bp, Artificial Sequence
  Description of Artificial Sequence: Synthetic probe
ggaggaaatatgctctcaacacttcagcttcccgatatccgacggtagtgttatgatgtaaaagtttaaa

SEQ ID NO: 1267 - DNA, 70 bp, Artificial Sequence
  Description of Artificial Sequence: Synthetic probe
aataaaataagtcaatttctacttcagcttcccgatatccgacggtagtgtctgtatcctttcctcaaaa

SEQ ID NO: 1268 - DNA, 70 bp, Artificial Sequence
  Description of Artificial Sequence: Synthetic probe
aaaattatgcacatgtaaatatgcttcagcttcccgatatccgacggtagtgttgtctgacaattccagg

SEQ ID NO: 1269 - DNA, 70 bp, Artificial Sequence
  Description of Artificial Sequence: Synthetic probe
actattcaacttttctggcacttcagcttcccgatatccgacggtagtgtgcagaatcaacagaagggat

SEQ ID NO: 1270 - DNA, 70 bp, Artificial Sequence
  Description of Artificial Sequence: Synthetic probe
tctccatacagatttggacttcagcttcccgatatccgacggtagtgtctttccaatttttcagatagat

SEQ ID NO: 1271 - DNA, 70 bp, Artificial Sequence
  Description of Artificial Sequence: Synthetic probe
aggaacagatattcacttgacttcagcttcccgatatccgacggtagtgtctaaacaatgtacatgaaca

SEQ ID NO: 1272 - DNA, 70 bp, Artificial Sequence
  Description of Artificial Sequence: Synthetic probe
ctggtccagctaaaataaacttcagcttcccgatatccgacggtagtgtttaataatatgaatttctctc

SEQ ID NO: 1273 - DNA, 70 bp, Artificial Sequence
  Description of Artificial Sequence: Synthetic probe
tctgtatcctttcctcttcagcttcccgatatccgacggtagtgtaatatgtttgctttctcttctctaa

SEQ ID NO: 1274 - DNA, 70 bp, Artificial Sequence
  Description of Artificial Sequence: Synthetic probe
atatgtctgacaattccaggccttcagcttcccgatatccgacggtagtgtatataagaattaaacttat

SEQ ID NO: 1275 - DNA, 70 bp, Artificial Sequence
  Description of Artificial Sequence: Synthetic probe
gcagaatcaacagaagggacttcagcttcccgatatccgacggtagtgtgccaccatacttggctcctat

SEQ ID NO: 1276 - DNA, 70 bp, Artificial Sequence
  Description of Artificial Sequence: Synthetic probe
ttccaatttttcagatagattgtccttcagcttcccgatatccgacggtagtgtagttgggattacaggc

SEQ ID NO: 1277 - DNA, 70 bp, Artificial Sequence
  Description of Artificial Sequence: Synthetic probe
ggttaaaaagctttttttcaccttcagcttcccgatatccgacggtagtgtgcttgtaacaagatgagtg

SEQ ID NO: 1278 - DNA, 70 bp, Artificial Sequence
  Description of Artificial Sequence: Synthetic probe
gaataatcatatcacaaatgtcacttcagcttcccgatatccgacggtagtgtcgaagtgtccatagtcc

SEQ ID NO: 1279 - DNA, 70 bp, Artificial Sequence
  Description of Artificial Sequence: Synthetic probe
tacaagaaccagttggcacttcagcttcccgatatccgacggtagtgtttttattcattgaaaatttttt

SEQ ID NO: 1280 - DNA, 70 bp, Artificial Sequence
  Description of Artificial Sequence: Synthetic probe
ttggaaccagcgcagcttcagcttcccgatatccgacggtagtgtaaaaattgataacctatagaatgca

SEQ ID NO: 1281 - DNA, 70 bp, Artificial Sequence
  Description of Artificial Sequence: Synthetic probe
tgacaaaaatcatttctattcttcagcttcccgatatccgacggtagtgttactaaactctaaagatatc

SEQ ID NO: 1282 - DNA, 70 bp, Artificial Sequence
  Description of Artificial Sequence: Synthetic probe
atgaaggtaacagcaatgaagcttcagcttcccgatatccgacggtagtgttaataaaccaacaaatttg

SEQ ID NO: 1283 - DNA, 70 bp, Artificial Sequence
  Description of Artificial Sequence: Synthetic probe
cttgtacctgaaaaagactaaacttcagcttcccgatatccgacggtagtgtcaaagtaaggctgccgtc

SEQ ID NO: 1284 - DNA, 70 bp, Artificial Sequence
  Description of Artificial Sequence: Synthetic probe
aacacaaaatgtaatttcataacttcagcttcccgatatccgacggtagtgtttcagagctttgtggaac

SEQ ID NO: 1285 - DNA, 70 bp, Artificial Sequence
  Description of Artificial Sequence: Synthetic probe
catagaaaacattgcaaataacacttcagcttcccgatatccgacggtagtgtaagaaccagttggcagt

SEQ ID NO: 1286 - DNA, 70 bp, Artificial Sequence
  Description of Artificial Sequence: Synthetic probe
tggactcctgcctgtgaaatacttcagcttcccgatatccgacggtagtgttggaaccagcgcagtgttg

SEQ ID NO: 1287 - DNA, 70 bp, Artificial Sequence
  Description of Artificial Sequence: Synthetic probe
agcttgtaacaagatgagtgcttcagcttcccgatatccgacggtagtgttgacaaaaatcatttctatt

SEQ ID NO: 1288 - DNA, 70 bp, Artificial Sequence
  Description of Artificial Sequence: Synthetic probe
gcacgaagtgtccatagtcctcttcagcttcccgatatccgacggtagtgttgaaggtaacagcaatgaa

SEQ ID NO: 1289 - DNA, 70 bp, Artificial Sequence
  Description of Artificial Sequence: Synthetic probe
ttcaaagtaaggctgccgtcttcagcttcccgatatccgacggtagtgttcatagtacctgttgttaaaa

SEQ ID NO: 1290 - DNA, 70 bp, Artificial Sequence
  Description of Artificial Sequence: Synthetic probe
aattcagagctttgtggaacagcttcagcttcccgatatccgacggtagtgttgcttagctaaagttaat

SEQ ID NO: 1291 - DNA, 70 bp, Artificial Sequence
  Description of Artificial Sequence: Synthetic probe
aacaatttttaaatccttcagcttcccgatatccgacggtagtgtaggataataccaactcttccttctc

SEQ ID NO: 1292 - DNA, 70 bp, Artificial Sequence
  Description of Artificial Sequence: Synthetic probe
tacatttcaattttatgctacttcagcttcccgatatccgacggtagtgttgatattcatggctaaagtc

SEQ ID NO: 1293 - DNA, 70 bp, Artificial Sequence
  Description of Artificial Sequence: Synthetic probe
cctagggcacatatcacattaaacttcagcttcccgatatccgacggtagtgtacagcccactgcaatgt

SEQ ID NO: 1294 - DNA, 70 bp, Artificial Sequence
  Description of Artificial Sequence: Synthetic probe
tgtgaacgactttattcacactcttcagcttcccgatatccgacggtagtgtagctatccacatctatgc

SEQ ID NO: 1295 - DNA, 70 bp, Artificial Sequence
  Description of Artificial Sequence: Synthetic probe
tgaacctcatgttatttctctcttcagcttcccgatatccgacggtagtgtagttaaaaagatgataaga

SEQ ID NO: 1296 - DNA, 70 bp, Artificial Sequence
  Description of Artificial Sequence: Synthetic probe
cctatagatgcacaaaagacgcttcagcttcccgatatccgacggtagtgttacttgtctgaattttttt

SEQ ID NO: 1297 - DNA, 70 bp, Artificial Sequence
  Description of Artificial Sequence: Synthetic probe
aataccaactcttccttctcccttcagcttcccgatatccgacggtagtgtcctcatgctattactcata

SEQ ID NO: 1298 - DNA, 70 bp, Artificial Sequence
  Description of Artificial Sequence: Synthetic probe
tgatattcatggctaaagtcacttcagcttcccgatatccgacggtagtgtgctcaatatacggtatata

SEQ ID NO: 1299 - DNA, 70 bp, Artificial Sequence
  Description of Artificial Sequence: Synthetic probe
tttacagcccactgcacttcagcttcccgatatccgacggtagtgttcaatttatctgtaatgttttatt

SEQ ID NO: 1300 - DNA, 70 bp, Artificial Sequence
  Description of Artificial Sequence: Synthetic probe
ttatttgtcgggcttttcacttcagcttcccgatatccgacggtagtgtgtcaatgaacttaaagactcg

SEQ ID NO: 1301 - DNA, 70 bp, Artificial Sequence
  Description of Artificial Sequence: Synthetic probe
gcaacacttgctatttgtcacttcagcttcccgatatccgacggtagtgtggtaggtttaccttctgttg

SEQ ID NO: 1302 - DNA, 70 bp, Artificial Sequence
  Description of Artificial Sequence: Synthetic probe
atctttcttcacgtgtgaacttcagcttcccgatatccgacggtagtgtacacagtctaacaaagcaagc

SEQ ID NO: 1303 - DNA, 70 bp, Artificial Sequence
  Description of Artificial Sequence: Synthetic probe
tttggccccctgagggcccttcagcttcccgatatccgacggtagtgttcaggctactgggattcactta

SEQ ID NO: 1304 - DNA, 70 bp, Artificial Sequence
  Description of Artificial Sequence: Synthetic probe
tttgctgtgagatctttgacacttcagcttcccgatatccgacggtagtgttagattctgctaacacatt

SEQ ID NO: 1305 - DNA, 70 bp, Artificial Sequence
  Description of Artificial Sequence: Synthetic probe
tatggcatttccaccttctcttcagcttcccgatatccgacggtagtgttctactgtacaataataatgt

SEQ ID NO: 1306 - DNA, 70 bp, Artificial Sequence
  Description of Artificial Sequence: Synthetic probe
ttattgagaaggaaatgttctcttcagcttcccgatatccgacggtagtgtaaacatgtgtgtttaatat

SEQ ID NO: 1307 - DNA, 70 bp, Artificial Sequence
  Description of Artificial Sequence: Synthetic probe
cttcctaaaaaataacttgtaacttcagcttcccgatatccgacggtagtgtttcttgtatggtttggtt

SEQ ID NO: 1308 - DNA, 70 bp, Artificial Sequence
  Description of Artificial Sequence: Synthetic probe
agacaatttcacaattagtttgcttcagcttcccgatatccgacggtagtgtaatcataactttcgagag

SEQ ID NO: 1309 - DNA, 70 bp, Artificial Sequence
  Description of Artificial Sequence: Synthetic probe
caacatttttgtttttaagaatggccttcagcttcccgatatccgacggtagtgttcttcacgtgtgaat

SEQ ID NO: 1310 - DNA, 70 bp, Artificial Sequence
  Description of Artificial Sequence: Synthetic probe
cagatcgcatctgaaataaaaataacttcagcttcccgatatccgacggtagtgtccccctgagggccag

SEQ ID NO: 1311 - DNA, 70 bp, Artificial Sequence
  Description of Artificial Sequence: Synthetic probe
tcaatgaacttaaagactcttcagcttcccgatatccgacggtagtgtattttgctgtgagatctttgac

SEQ ID NO: 1312 - DNA, 70 bp, Artificial Sequence
  Description of Artificial Sequence: Synthetic probe
ggtaggtttaccttctgttggccttcagcttcccgatatccgacggtagtgttggcatttccaccttctg

SEQ ID NO: 1313 - DNA, 70 bp, Artificial Sequence
  Description of Artificial Sequence: Synthetic probe
cattcttgtatggtttggttgaccttcagcttcccgatatccgacggtagtgtttgagaaggaaatgttc

SEQ ID NO: 1314 - DNA, 70 bp, Artificial Sequence
  Description of Artificial Sequence: Synthetic probe
ataatcataactttcgagagcttcagcttcccgatatccgacggtagtgttcaaatctcaccctctggcc

SEQ ID NO: 1315 - DNA, 70 bp, Artificial Sequence
  Description of Artificial Sequence: Synthetic probe
gtggaagattttcacttattcacttcagcttcccgatatccgacggtagtgtactcttccctgatccagt

SEQ ID NO: 1316 - DNA, 70 bp, Artificial Sequence
  Description of Artificial Sequence: Synthetic probe
attggaatattttatcctgtcacttcagcttcccgatatccgacggtagtgtgtctcaaaaaagctgata

SEQ ID NO: 1317 - DNA, 70 bp, Artificial Sequence
  Description of Artificial Sequence: Synthetic probe
ggctttcctccactgttgccttcagcttcccgatatccgacggtagtgtactggagaaaaaagacagcaa

SEQ ID NO: 1318 - DNA, 70 bp, Artificial Sequence
  Description of Artificial Sequence: Synthetic probe
tcagtattgtacttcaataaacttcagcttcccgatatccgacggtagtgtctggatttctccttcagtg

SEQ ID NO: 1319 - DNA, 70 bp, Artificial Sequence
  Description of Artificial Sequence: Synthetic probe
ataggtaccatgccataaacacttcagcttcccgatatccgacggtagtgtttgaatcccaagacacacc

SEQ ID NO: 1320 - DNA, 70 bp, Artificial Sequence
  Description of Artificial Sequence: Synthetic probe
agtgatgggatcacttctgtgcttcagcttcccgatatccgacggtagtgtgctttcctccactgttgca

SEQ ID NO: 1321 - DNA, 70 bp, Artificial Sequence
  Description of Artificial Sequence: Synthetic probe
ccaagaggcccacctataaggcttcagcttcccgatatccgacggtagtgtgctcacctgtggtatcact

SEQ ID NO: 1322 - DNA, 70 bp, Artificial Sequence
  Description of Artificial Sequence: Synthetic probe
gtactcttccctgatccagtcttcagcttcccgatatccgacggtagtgttgccttttttctggctaagt

SEQ ID NO: 1323 - DNA, 70 bp, Artificial Sequence
  Description of Artificial Sequence: Synthetic probe
tagtctcaaaaaagctgacttcagcttcccgatatccgacggtagtgtaaatagcagtaaaaaatataat

SEQ ID NO: 1324 - DNA, 70 bp, Artificial Sequence
  Description of Artificial Sequence: Synthetic probe
tctggatttctccttcagtgcttcagcttcccgatatccgacggtagtgttgaatttcttgagtacaagt

SEQ ID NO: 1325 - DNA, 70 bp, Artificial Sequence
  Description of Artificial Sequence: Synthetic probe
attgaatcccaagacacacccttcagcttcccgatatccgacggtagtgtaacaaatatattttgcagag

SEQ ID NO: 1326 - DNA, 70 bp, Artificial Sequence
  Description of Artificial Sequence: Synthetic probe
taagaaacacccatgtacttcttcagcttcccgatatccgacggtagtgtggatccaagttttttctaaa

SEQ ID NO: 1327 - DNA, 70 bp, Artificial Sequence
  Description of Artificial Sequence: Synthetic probe
ttcaagtagaaaaattattttacttcagcttcccgatatccgacggtagtgtcttgatcactccactgtt

SEQ ID NO: 1328 - DNA, 70 bp, Artificial Sequence
  Description of Artificial Sequence: Synthetic probe
tttcccttattgtattgtaaaacttcagcttcccgatatccgacggtagtgtacctcatctgcaactttc

SEQ ID NO: 1329 - DNA, 70 bp, Artificial Sequence
  Description of Artificial Sequence: Synthetic probe
tgaataacttaaataacttttcttcagcttcccgatatccgacggtagtgttcaaaatcatttcagttag

SEQ ID NO: 1330 - DNA, 70 bp, Artificial Sequence
  Description of Artificial Sequence: Synthetic probe
caaaaaagaaaagaagaagaaagcttcagcttcccgatatccgacggtagtgttgtgttggtatgagtta

SEQ ID NO: 1331 - DNA, 70 bp, Artificial Sequence
  Description of Artificial Sequence: Synthetic probe
cagaaaaaataaatactttctcttcagcttcccgatatccgacggtagtgtagaatgatgtcagctatat

SEQ ID NO: 1332 - DNA, 70 bp, Artificial Sequence
  Description of Artificial Sequence: Synthetic probe
ggatccaagttttttctaaacttcagcttcccgatatccgacggtagtgtcacacatacatgcacacaaa

SEQ ID NO: 1333 - DNA, 70 bp, Artificial Sequence
  Description of Artificial Sequence: Synthetic probe
ttcttgatcactccactgtcttcagcttcccgatatccgacggtagtgtagggtactccattttaaagtt

SEQ ID NO: 1334 - DNA, 70 bp, Artificial Sequence
  Description of Artificial Sequence: Synthetic probe
ccaccatttgaattgattgagcttcagcttcccgatatccgacggtagtgtatcacagatctgagcccaa

SEQ ID NO: 1335 - DNA, 70 bp, Artificial Sequence
  Description of Artificial Sequence: Synthetic probe
ccaatccctctacccccactcttcagcttcccgatatccgacggtagtgtagtcaagcttcccaggaaac

SEQ ID NO: 1336 - DNA, 70 bp, Artificial Sequence
  Description of Artificial Sequence: Synthetic probe
tgagaacagatctagccaagccttcagcttcccgatatccgacggtagtgtagacatgacagcctaatag

SEQ ID NO: 1337 - DNA, 70 bp, Artificial Sequence
  Description of Artificial Sequence: Synthetic probe
tcaagcagcaagatcttcgccttcttcagcttcccgatatccgacggtagtgttcttgggggagaccccc

SEQ ID NO: 1338 - DNA, 70 bp, Artificial Sequence
  Description of Artificial Sequence: Synthetic probe
tggatccaaatgagcactgggcttcagcttcccgatatccgacggtagtgttcatttccactgggcaatt

SEQ ID NO: 1339 - DNA, 70 bp, Artificial Sequence
  Description of Artificial Sequence: Synthetic probe
gttctgaaagcttatgtttttcacttcagcttcccgatatccgacggtagtgtcagcccccatccacaag

SEQ ID NO: 1340 - DNA, 70 bp, Artificial Sequence
  Description of Artificial Sequence: Synthetic probe
tgacattctaaaaataaacacaggcttcagcttcccgatatccgacggtagtgttgcttgtggccatggc

SEQ ID NO: 1341 - DNA, 70 bp, Artificial Sequence
  Description of Artificial Sequence: Synthetic probe
acagagttaaaaacactcaagccttcagcttcccgatatccgacggtagtgtagaacagatctagccaag

SEQ ID NO: 1342 - DNA, 70 bp, Artificial Sequence
  Description of Artificial Sequence: Synthetic probe
agttagagaagatagttcagacttcagcttcccgatatccgacggtagtgtcaagcagcaagatcttcgc

SEQ ID NO: 1343 - DNA, 70 bp, Artificial Sequence
  Description of Artificial Sequence: Synthetic probe
tatcacagatctgagcccaaccttcagcttcccgatatccgacggtagtgtggatccaaatgagcactgg

SEQ ID NO: 1344 - DNA, 70 bp, Artificial Sequence
  Description of Artificial Sequence: Synthetic probe
agtcaagcttcccaggaacttcagcttcccgatatccgacggtagtgtaagtaacagaacatctgaaact

SEQ ID NO: 1345 - DNA, 70 bp, Artificial Sequence
  Description of Artificial Sequence: Synthetic probe
acacagcccccatccacaacttcagcttcccgatatccgacggtagtgttgattctgttcccactgtgct

SEQ ID NO: 1346 - DNA, 70 bp, Artificial Sequence
  Description of Artificial Sequence: Synthetic probe
caactgcttgtggccatggccttcagcttcccgatatccgacggtagtgttgtgtcaccatgaagcaggc

SEQ ID NO: 1347 - DNA, 70 bp, Artificial Sequence
  Description of Artificial Sequence: Synthetic probe
tttcacataatgttgatatagcttcagcttcccgatatccgacggtagtgtgttttagagttcttctaat

SEQ ID NO: 1348 - DNA, 70 bp, Artificial Sequence
  Description of Artificial Sequence: Synthetic probe
taaattacttatttctttaagttccttcagcttcccgatatccgacggtagtgtactgtgcaatcagcaa

SEQ ID NO: 1349 - DNA, 70 bp, Artificial Sequence
  Description of Artificial Sequence: Synthetic probe
tatgtctattgttctattatctcttcagcttcccgatatccgacggtagtgtgcttctatcctgtgttca

SEQ ID NO: 1350 - DNA, 70 bp, Artificial Sequence
  Description of Artificial Sequence: Synthetic probe
taatgatctgtatttaccttgcttcagcttcccgatatccgacggtagtgtccaaaaattgttggcattc

SEQ ID NO: 1351 - DNA, 70 bp, Artificial Sequence
  Description of Artificial Sequence: Synthetic probe
taccacacataatatcacagacttcagcttcccgatatccgacggtagtgttcttaagtaaagttataaa

SEQ ID NO: 1352 - DNA, 70 bp, Artificial Sequence
  Description of Artificial Sequence: Synthetic probe
ggtatgttctagaaaagaaagacttcagcttcccgatatccgacggtagtgttcaagaattacaagggca

SEQ ID NO: 1353 - DNA, 70 bp, Artificial Sequence
  Description of Artificial Sequence: Synthetic probe
tgttttagagttcttctaacttcagcttcccgatatccgacggtagtgtgcaggaactatcacatgtgag

SEQ ID NO: 1354 - DNA, 70 bp, Artificial Sequence
  Description of Artificial Sequence: Synthetic probe
aattactgtgcaatcagcaacttcagcttcccgatatccgacggtagtgtagaacttgtacattgttgca

SEQ ID NO: 1355 - DNA, 70 bp, Artificial Sequence
  Description of Artificial Sequence: Synthetic probe
ttgcttctatcctgtgttccttcagcttcccgatatccgacggtagtgttggctgtatgatacatatttt

SEQ ID NO: 1356 - DNA, 70 bp, Artificial Sequence
  Description of Artificial Sequence: Synthetic probe
caatcaggtatgtcacacttcagcttcccgatatccgacggtagtgtccgcactttgttctcttctatga

SEQ ID NO: 1357 - DNA, 70 bp, Artificial Sequence
  Description of Artificial Sequence: Synthetic probe
aatgtccagagccttgcacttcagcttcccgatatccgacggtagtgtcagtttctggatggaatcgtac

SEQ ID NO: 1358 - DNA, 70 bp, Artificial Sequence
  Description of Artificial Sequence: Synthetic probe
agttccggtggggaaagagccttcagcttcccgatatccgacggtagtgtccatgaggtgactgtcccac

SEQ ID NO: 1359 - DNA, 70 bp, Artificial Sequence
  Description of Artificial Sequence: Synthetic probe
tggggcttagacttgcacttcttcagcttcccgatatccgacggtagtgtggtaactgttccacgagctc

SEQ ID NO: 1360 - DNA, 70 bp, Artificial Sequence
  Description of Artificial Sequence: Synthetic probe
tgtctcctctttcagagcagccttcagcttcccgatatccgacggtagtgtttcatccttgttttctgag

SEQ ID NO: 1361 - DNA, 70 bp, Artificial Sequence
  Description of Artificial Sequence: Synthetic probe
gccttgtatcttgcacctcttcagcttcccgatatccgacggtagtgtaatgtttcttttttaaaaaaaa

SEQ ID NO: 1362 - DNA, 70 bp, Artificial Sequence
  Description of Artificial Sequence: Synthetic probe
aaggaaaataaaagtcaaagaatgccttcagcttcccgatatccgacggtagtgtgaggctcctctcgtt

SEQ ID NO: 1363 - DNA, 70 bp, Artificial Sequence
  Description of Artificial Sequence: Synthetic probe
agggacagaaactggcacaggccttcagcttcccgatatccgacggtagtgttgtcggaggggctgatgg

SEQ ID NO: 1364 - DNA, 70 bp, Artificial Sequence
  Description of Artificial Sequence: Synthetic probe
gacagaaggcaggtcagaccagacttcagcttcccgatatccgacggtagtgttccggtggggaaagagc

SEQ ID NO: 1365 - DNA, 70 bp, Artificial Sequence
  Description of Artificial Sequence: Synthetic probe
ggaaatggctgttagtgagacttcagcttcccgatatccgacggtagtgttggggcttagacttgcactt

SEQ ID NO: 1366 - DNA, 70 bp, Artificial Sequence
  Description of Artificial Sequence: Synthetic probe
cactttgttctcttctatgacccttcagcttcccgatatccgacggtagtgttctcctctttcagagcag

SEQ ID NO: 1367 - DNA, 70 bp, Artificial Sequence
  Description of Artificial Sequence: Synthetic probe
gtttctggatggaatccttcagcttcccgatatccgacggtagtgttaaagccttgtatcttgcacctct

SEQ ID NO: 1368 - DNA, 70 bp, Artificial Sequence
  Description of Artificial Sequence: Synthetic probe
cggaagaggctcctctcgtcttcagcttcccgatatccgacggtagtgttgtcaacatttatgctgctct

SEQ ID NO: 1369 - DNA, 70 bp, Artificial Sequence
  Description of Artificial Sequence: Synthetic probe
cctgtcggaggggctgacttcagcttcccgatatccgacggtagtgtgctccaattccatgagcaaatgt

SEQ ID NO: 1370 - DNA, 70 bp, Artificial Sequence
  Description of Artificial Sequence: Synthetic probe
atctcatggagaccatacaacttcagcttcccgatatccgacggtagtgtgccagctctctatcccattc

SEQ ID NO: 1371 - DNA, 70 bp, Artificial Sequence
  Description of Artificial Sequence: Synthetic probe
ttaacccaagtattatagagaccttcagcttcccgatatccgacggtagtgttgagtttaggatttttct

SEQ ID NO: 1372 - DNA, 70 bp, Artificial Sequence
  Description of Artificial Sequence: Synthetic probe
attcacacaagtatatccaaggagcttcagcttcccgatatccgacggtagtgtaaaacatcgccgaagg

SEQ ID NO: 1373 - DNA, 70 bp, Artificial Sequence
  Description of Artificial Sequence: Synthetic probe
gtcctatttcccttaacacttcagcttcccgatatccgacggtagtgtaaaagattccatagaacataaa

SEQ ID NO: 1374 - DNA, 70 bp, Artificial Sequence
  Description of Artificial Sequence: Synthetic probe
agttgcatgtgcaaatatttcttcagcttcccgatatccgacggtagtgttgagatccttacccctaaat

SEQ ID NO: 1375 - DNA, 70 bp, Artificial Sequence
  Description of Artificial Sequence: Synthetic probe
aaaagaataaaaagtgggacccttcagcttcccgatatccgacggtagtgttgtgatacataatgaatgt

SEQ ID NO: 1376 - DNA, 70 bp, Artificial Sequence
  Description of Artificial Sequence: Synthetic probe
gccagctctctatcccacttcagcttcccgatatccgacggtagtgttttcataatcacaaaaatgaata

SEQ ID NO: 1377 - DNA, 70 bp, Artificial Sequence
  Description of Artificial Sequence: Synthetic probe
aatgagtttaggatttttctttgcttcagcttcccgatatccgacggtagtgttcaccagatttcgtagt

SEQ ID NO: 1378 - DNA, 70 bp, Artificial Sequence
  Description of Artificial Sequence: Synthetic probe
agaaaaaacatcgccgacttcagcttcccgatatccgacggtagtgtttggattcatcctttatattttt

SEQ ID NO: 1379 - DNA, 70 bp, Artificial Sequence
  Description of Artificial Sequence: Synthetic probe
aagattccatagaacataaacttcagcttcccgatatccgacggtagtgtggtggtttcttagtgtttgg

SEQ ID NO: 1380 - DNA, 70 bp, Artificial Sequence
  Description of Artificial Sequence: Synthetic probe
agggtcataccatatgtgaacttcagcttcccgatatccgacggtagtgtcccagtaagagaggctgtac

SEQ ID NO: 1381 - DNA, 70 bp, Artificial Sequence
  Description of Artificial Sequence: Synthetic probe
ggagacttaaaatgagtttacttcagcttcccgatatccgacggtagtgtcgggtcataggaagctatga

SEQ ID NO: 1382 - DNA, 70 bp, Artificial Sequence
  Description of Artificial Sequence: Synthetic probe
cagtgtcctcacaataacttcagcttcccgatatccgacggtagtgtcctaatttatgacattaaaacat

SEQ ID NO: 1383 - DNA, 70 bp, Artificial Sequence
  Description of Artificial Sequence: Synthetic probe
ggccaaaaatggctgggtgcttcagcttcccgatatccgacggtagtgtcccttacttgtaccagctcac

SEQ ID NO: 1384 - DNA, 70 bp, Artificial Sequence
  Description of Artificial Sequence: Synthetic probe
ctcatctgcattccacttcagcttcccgatatccgacggtagtgtaggcatattaaattaatttcagcat

SEQ ID NO: 1385 - DNA, 70 bp, Artificial Sequence
  Description of Artificial Sequence: Synthetic probe
ataaatcaaactaaacatagctcttcagcttcccgatatccgacggtagtgttcctgccatttatttaat

SEQ ID NO: 1386 - DNA, 70 bp, Artificial Sequence
  Description of Artificial Sequence: Synthetic probe
caacacaagacttttcatctttagcttcagcttcccgatatccgacggtagtgtagagcgttcctccttg

SEQ ID NO: 1387 - DNA, 70 bp, Artificial Sequence
  Description of Artificial Sequence: Synthetic probe
ttctcataaaataccctgagaacttcagcttcccgatatccgacggtagtgttaagcctatgcctagata

SEQ ID NO: 1388 - DNA, 70 bp, Artificial Sequence
  Description of Artificial Sequence: Synthetic probe
aacagagaaattaaatttcacttcagcttcccgatatccgacggtagtgtcagtgtcctcacaataaaga

SEQ ID NO: 1389 - DNA, 70 bp, Artificial Sequence
  Description of Artificial Sequence: Synthetic probe
tggtgacttcctacaaaagggcttcagcttcccgatatccgacggtagtgtgccaaaaatggctgggtgt

SEQ ID NO: 1390 - DNA, 70 bp, Artificial Sequence
  Description of Artificial Sequence: Synthetic probe
cccagtaagagaggctgtcttcagcttcccgatatccgacggtagtgtttctcatctgcattccaatgtg

SEQ ID NO: 1391 - DNA, 70 bp, Artificial Sequence
  Description of Artificial Sequence: Synthetic probe
cgggtcataggaagctcttcagcttcccgatatccgacggtagtgttcttataaatcaaactaaacatag

SEQ ID NO: 1392 - DNA, 70 bp, Artificial Sequence
  Description of Artificial Sequence: Synthetic probe
cgatagagcgttcctcctcttcagcttcccgatatccgacggtagtgtgcctgtgcaaggaagtattacc

SEQ ID NO: 1393 - DNA, 70 bp, Artificial Sequence
  Description of Artificial Sequence: Synthetic probe
cataagcctatgcctagacttcagcttcccgatatccgacggtagtgtcgatacagaatatatgtgccat

SEQ ID NO: 1394 - DNA, 70 bp, Artificial Sequence
  Description of Artificial Sequence: Synthetic probe
tattctattcatctagcttactacttcagcttcccgatatccgacggtagtgtacacggcttgacagctt

SEQ ID NO: 1395 - DNA, 70 bp, Artificial Sequence
  Description of Artificial Sequence: Synthetic probe
tattaagtaaaggtaatgaaacttcagcttcccgatatccgacggtagtgtagttgtccaatacttattt

SEQ ID NO: 1396 - DNA, 70 bp, Artificial Sequence
  Description of Artificial Sequence: Synthetic probe
actaattcagttattatgcattccttcagcttcccgatatccgacggtagtgtggttgttggaaaggaga

SEQ ID NO: 1397 - DNA, 70 bp, Artificial Sequence
  Description of Artificial Sequence: Synthetic probe
atattataagtaaaattataacttcagcttcccgatatccgacggtagtgtaggtacatacttcatcaaa

SEQ ID NO: 1398 - DNA, 70 bp, Artificial Sequence
  Description of Artificial Sequence: Synthetic probe
taatttcaacaaacaaaatacacttcagcttcccgatatccgacggtagtgttagtgcctaaaagattaa

SEQ ID NO: 1399 - DNA, 70 bp, Artificial Sequence
  Description of Artificial Sequence: Synthetic probe
tctaaaagaaaaatgcttcagcttcccgatatccgacggtagtgtctccgcctttccagttgtataattt

SEQ ID NO: 1400 - DNA, 70 bp, Artificial Sequence
  Description of Artificial Sequence: Synthetic probe
agaacacggcttgacagccttcagcttcccgatatccgacggtagtgtactattatctgacccaggaaaa

SEQ ID NO: 1401 - DNA, 70 bp, Artificial Sequence
  Description of Artificial Sequence: Synthetic probe
aagttgtccaatacttattttcttcagcttcccgatatccgacggtagtgtgagcaagacttaaccacta

SEQ ID NO: 1402 - DNA, 70 bp, Artificial Sequence
  Description of Artificial Sequence: Synthetic probe
tcaggttgttggaaaggagacttcagcttcccgatatccgacggtagtgtgtttccagaatagggaagct

SEQ ID NO: 1403 - DNA, 70 bp, Artificial Sequence
  Description of Artificial Sequence: Synthetic probe
gagcacactaaaatctaggtacttcagcttcccgatatccgacggtagtgttccacacgaaatgtgccaa

SEQ ID NO: 1404 - DNA, 70 bp, Artificial Sequence
  Description of Artificial Sequence: Synthetic probe
atatgatcaaacacttcgtggtcttcagcttcccgatatccgacggtagtgtggagtgccacttgcaaag

SEQ ID NO: 1405 - DNA, 70 bp, Artificial Sequence
  Description of Artificial Sequence: Synthetic probe
aaaaagggcaaggactatcagcttcagcttcccgatatccgacggtagtgttttaatgacactgaagatc

SEQ ID NO: 1406 - DNA, 70 bp, Artificial Sequence
  Description of Artificial Sequence: Synthetic probe
tcatcattctccctagccccttcagcttcccgatatccgacggtagtgtgtctcaaaaaaaaaaaaaaaa

SEQ ID NO: 1407 - DNA, 70 bp, Artificial Sequence
  Description of Artificial Sequence: Synthetic probe
gaaagaaagcaagtaaaaggagccttcagcttcccgatatccgacggtagtgtacaactcccagattagc

SEQ ID NO: 1408 - DNA, 70 bp, Artificial Sequence
  Description of Artificial Sequence: Synthetic probe
cccctagaaactaacaatcacttcagcttcccgatatccgacggtagtgtccaagtccacagaaggcaga

SEQ ID NO: 1409 - DNA, 70 bp, Artificial Sequence
  Description of Artificial Sequence: Synthetic probe
aaaacaggtgtcattgtatcttcccttcagcttcccgatatccgacggtagtgtagggcaaggactatca

SEQ ID NO: 1410 - DNA, 70 bp, Artificial Sequence
  Description of Artificial Sequence: Synthetic probe
gtccctggaaaataaaagcacagcttcagcttcccgatatccgacggtagtgttcattctccctagccca

SEQ ID NO: 1411 - DNA, 70 bp, Artificial Sequence
  Description of Artificial Sequence: Synthetic probe
atccacacgaaatgtcttcagcttcccgatatccgacggtagtgtttatgaaaataggttgctacctgta

SEQ ID NO: 1412 - DNA, 70 bp, Artificial Sequence
  Description of Artificial Sequence: Synthetic probe
gaggagtgccacttgcaaaggcttcagcttcccgatatccgacggtagtgtaatttttaaaactttcaag

SEQ ID NO: 1413 - DNA, 70 bp, Artificial Sequence
  Description of Artificial Sequence: Synthetic probe
gtaacaactcccagattagcccttcagcttcccgatatccgacggtagtgtactaaagtgggctttttga

SEQ ID NO: 1414 - DNA, 70 bp, Artificial Sequence
  Description of Artificial Sequence: Synthetic probe
ccaagtccacagaaggcagacttcagcttcccgatatccgacggtagtgttctatgcatagagcagtcct

SEQ ID NO: 1415 - DNA, 70 bp, Artificial Sequence
  Description of Artificial Sequence: Synthetic probe
tttattatcaaatagatggtaacacttcagcttcccgatatccgacggtagtgtttcactgatcttccca

SEQ ID NO: 1416 - DNA, 70 bp, Artificial Sequence
  Description of Artificial Sequence: Synthetic probe
cttttattcaacagatgggccttcagcttcccgatatccgacggtagtgttcaatcatttctgaggtaat

SEQ ID NO: 1417 - DNA, 70 bp, Artificial Sequence
  Description of Artificial Sequence: Synthetic probe
ctgctcaaggttttaagtcacttcagcttcccgatatccgacggtagtgtgtatgccttaacagattgga

SEQ ID NO: 1418 - DNA, 70 bp, Artificial Sequence
  Description of Artificial Sequence: Synthetic probe
aacaagtcaaattatctattaagacttcagcttcccgatatccgacggtagtgtttccattgcttcttcc

SEQ ID NO: 1419 - DNA, 70 bp, Artificial Sequence
  Description of Artificial Sequence: Synthetic probe
atcaatcaatcaatctaatagtcttcagcttcccgatatccgacggtagtgtttactgtcttaagttttc

SEQ ID NO: 1420 - DNA, 70 bp, Artificial Sequence
  Description of Artificial Sequence: Synthetic probe
ctgatctctgtaaatcaacttcagcttcccgatatccgacggtagtgtactaacaatattgaaattattg

SEQ ID NO: 1421 - DNA, 70 bp, Artificial Sequence
  Description of Artificial Sequence: Synthetic probe
gtctttcactgatcttcccacttcagcttcccgatatccgacggtagtgttttaaaaaattaaggacaga

SEQ ID NO: 1422 - DNA, 70 bp, Artificial Sequence
  Description of Artificial Sequence: Synthetic probe
tcaatcatttctgaggtaacttcagcttcccgatatccgacggtagtgttggaagtctaccatgataaac

SEQ ID NO: 1423 - DNA, 70 bp, Artificial Sequence
  Description of Artificial Sequence: Synthetic probe
gtatgccttaacagattggacttcagcttcccgatatccgacggtagtgtttgtcacaaacatcaaatat

SEQ ID NO: 1424 - DNA, 70 bp, Artificial Sequence
  Description of Artificial Sequence: Synthetic probe
ttttttccattgcttcttccccttcagcttcccgatatccgacggtagtgtcagaacttaaatgcaatca

SEQ ID NO: 1425 - DNA, 70 bp, Artificial Sequence
  Description of Artificial Sequence: Synthetic probe
acctggctccacatcatatgacctcttcagcttcccgatatccgacggtagtgtaggctgccttccgagt

SEQ ID NO: 1426 - DNA, 70 bp, Artificial Sequence
  Description of Artificial Sequence: Synthetic probe
tagagtctttctgcctatatttttcttcagcttcccgatatccgacggtagtgtgctgagctattgaagt

SEQ ID NO: 1427 - DNA, 70 bp, Artificial Sequence
  Description of Artificial Sequence: Synthetic probe
tttccggaggatgattcctcttcagcttcccgatatccgacggtagtgttttaaatcatagtatataatg

SEQ ID NO: 1428 - DNA, 70 bp, Artificial Sequence
  Description of Artificial Sequence: Synthetic probe
tgcagaatgagatggtggtgacttcagcttcccgatatccgacggtagtgtagaactgatctattgactg

SEQ ID NO: 1429 - DNA, 70 bp, Artificial Sequence
  Description of Artificial Sequence: Synthetic probe
cgagtgaccgccatgcgcttcagcttcccgatatccgacggtagtgttcttttcgcacatttttgcaaag

SEQ ID NO: 1430 - DNA, 70 bp, Artificial Sequence
  Description of Artificial Sequence: Synthetic probe
tgtttgtacagcccagggacttcagcttcccgatatccgacggtagtgtagtgaaggaaatttctttttc

SEQ ID NO: 1431 - DNA, 70 bp, Artificial Sequence
  Description of Artificial Sequence: Synthetic probe
ttattgctccaagagagtcacttcagcttcccgatatccgacggtagtgtagctggcaacttttataact

SEQ ID NO: 1432 - DNA, 70 bp, Artificial Sequence
  Description of Artificial Sequence: Synthetic probe
gaatggaagatctgagcatggtcttcagcttcccgatatccgacggtagtgtaccacaaagaaccctgag

SEQ ID NO: 1433 - DNA, 70 bp, Artificial Sequence
  Description of Artificial Sequence: Synthetic probe
tatttttcaaatatcagggatctcttcagcttcccgatatccgacggtagtgtgcatagggaagcacaga

SEQ ID NO: 1434 - DNA, 70 bp, Artificial Sequence
  Description of Artificial Sequence: Synthetic probe
aacaataaaattcaggatgttacttcagcttcccgatatccgacggtagtgttccggaggatgattcctt

SEQ ID NO: 1435 - DNA, 70 bp, Artificial Sequence
  Description of Artificial Sequence: Synthetic probe
tcagttctgttctataaaaaacttcagcttcccgatatccgacggtagtgtgcagaatgagatggtggtg

SEQ ID NO: 1436 - DNA, 70 bp, Artificial Sequence
  Description of Artificial Sequence: Synthetic probe
acataggctgccttccgagtcagtcttcagcttcccgatatccgacggtagtgttgaccgccatgcgcag

SEQ ID NO: 1437 - DNA, 70 bp, Artificial Sequence
  Description of Artificial Sequence: Synthetic probe
gaaggctgagctattcttcagcttcccgatatccgacggtagtgttaccatgtttgtacagcccagggaa

SEQ ID NO: 1438 - DNA, 70 bp, Artificial Sequence
  Description of Artificial Sequence: Synthetic probe
acaccacaaagaaccctgagacttcagcttcccgatatccgacggtagtgttattgctccaagagagtca

SEQ ID NO: 1439 - DNA, 70 bp, Artificial Sequence
  Description of Artificial Sequence: Synthetic probe
agtgcatagggaagcacttcagcttcccgatatccgacggtagtgtagcattatggtacattacctgtat

SEQ ID NO: 1440 - DNA, 70 bp, Artificial Sequence
  Description of Artificial Sequence: Synthetic probe
ttcttaataaaataattttattagcttcagcttcccgatatccgacggtagtgttcttgcttttgtaaga

SEQ ID NO: 1441 - DNA, 70 bp, Artificial Sequence
  Description of Artificial Sequence: Synthetic probe
attttaataatgaaatagtaatcttcagcttcccgatatccgacggtagtgtgttaagttatattccaat

SEQ ID NO: 1442 - DNA, 70 bp, Artificial Sequence
  Description of Artificial Sequence: Synthetic probe
tcattgtgctacatcttatacttcagcttcccgatatccgacggtagtgtacattctccatcactacttc

SEQ ID NO: 1443 - DNA, 70 bp, Artificial Sequence
  Description of Artificial Sequence: Synthetic probe
gcattattacatctactttatactcttcagcttcccgatatccgacggtagtgtacctcctcccagaagg

SEQ ID NO: 1444 - DNA, 70 bp, Artificial Sequence
  Description of Artificial Sequence: Synthetic probe
attatagaatcagaatagcacttcagcttcccgatatccgacggtagtgtttagagcaaacaatttttta

SEQ ID NO: 1445 - DNA, 70 bp, Artificial Sequence
  Description of Artificial Sequence: Synthetic probe
tatttataaaagagagcaaacttcagcttcccgatatccgacggtagtgtcacaaagaagaaaacagtta

SEQ ID NO: 1446 - DNA, 70 bp, Artificial Sequence
  Description of Artificial Sequence: Synthetic probe
atattcttgcttttgcttcagcttcccgatatccgacggtagtgttttattcgccattaggatgaaatcc

SEQ ID NO: 1447 - DNA, 70 bp, Artificial Sequence
  Description of Artificial Sequence: Synthetic probe
tcgttaagttatattccacttcagcttcccgatatccgacggtagtgtccagttatatcatcattctaat

SEQ ID NO: 1448 - DNA, 70 bp, Artificial Sequence
  Description of Artificial Sequence: Synthetic probe
acattctccatcactacttctgcttcagcttcccgatatccgacggtagtgtgtgatcctccttccagtt

SEQ ID NO: 1449 - DNA, 70 bp, Artificial Sequence
  Description of Artificial Sequence: Synthetic probe
tgcagggcctgcatggagtttactccttcagcttcccgatatccgacggtagtgtggcagagggcagcca

SEQ ID NO: 1450 - DNA, 70 bp, Artificial Sequence
  Description of Artificial Sequence: Synthetic probe
ctcacagcactaaagcagccagccttcagcttcccgatatccgacggtagtgtgatgaagcaaagggccc

SEQ ID NO: 1451 - DNA, 70 bp, Artificial Sequence
  Description of Artificial Sequence: Synthetic probe
gttcctgcactcgttcactcttcagcttcccgatatccgacggtagtgtagctgacaacacactgctgtc

SEQ ID NO: 1452 - DNA, 70 bp, Artificial Sequence
  Description of Artificial Sequence: Synthetic probe
ctccctcctgcaagaggtcttcagcttcccgatatccgacggtagtgtagatggcagagctacgagagca

SEQ ID NO: 1453 - DNA, 70 bp, Artificial Sequence
  Description of Artificial Sequence: Synthetic probe
ggcaggctgagtaaatggggtcttcagcttcccgatatccgacggtagtgtcacaccctctggggccctg

SEQ ID NO: 1454 - DNA, 70 bp, Artificial Sequence
  Description of Artificial Sequence: Synthetic probe
ctgttgggagtcccatgaaggcttcagcttcccgatatccgacggtagtgtcaggcacccctacctggtt

SEQ ID NO: 1455 - DNA, 70 bp, Artificial Sequence
  Description of Artificial Sequence: Synthetic probe
tgaaatgaagctcaaaaggcttcagcttcccgatatccgacggtagtgtgtggtatttccacactttttg

SEQ ID NO: 1456 - DNA, 70 bp, Artificial Sequence
  Description of Artificial Sequence: Synthetic probe
cctaggggaccatgcagcttcagcttcccgatatccgacggtagtgtattatgtataatactacagtgtg

SEQ ID NO: 1457 - DNA, 70 bp, Artificial Sequence
  Description of Artificial Sequence: Synthetic probe
caaatctctcttttttaatttcttcagcttcccgatatccgacggtagtgtacacaataaggatggcaga

SEQ ID NO: 1458 - DNA, 70 bp, Artificial Sequence
  Description of Artificial Sequence: Synthetic probe
catcactaaaatccttctgatgacttcagcttcccgatatccgacggtagtgttgacattgacgtggatg

SEQ ID NO: 1459 - DNA, 70 bp, Artificial Sequence
  Description of Artificial Sequence: Synthetic probe
acattctcacttactaacttcttcagcttcccgatatccgacggtagtgttgggattgctttgagcaaat

SEQ ID NO: 1460 - DNA, 70 bp, Artificial Sequence
  Description of Artificial Sequence: Synthetic probe
aaggttttccaaaagcacttcagcttcccgatatccgacggtagtgttccatgtatatatgttaagatta

SEQ ID NO: 1461 - DNA, 70 bp, Artificial Sequence
  Description of Artificial Sequence: Synthetic probe
gaagaaggctgtccccacttcagcttcccgatatccgacggtagtgtactttatatttaggtagacggtc

SEQ ID NO: 1462 - DNA, 70 bp, Artificial Sequence
  Description of Artificial Sequence: Synthetic probe
aacacaataaggatggcagcttcagcttcccgatatccgacggtagtgttgacatattgaaaagcacatt

SEQ ID NO: 1463 - DNA, 70 bp, Artificial Sequence
  Description of Artificial Sequence: Synthetic probe
gaatgacattgacgtggacttcagcttcccgatatccgacggtagtgtcttcagaggtagaattttgtac

SEQ ID NO: 1464 - DNA, 70 bp, Artificial Sequence
  Description of Artificial Sequence: Synthetic probe
tgggattgctttgagcacttcagcttcccgatatccgacggtagtgtacctgaaatgaagctcaaaaggt

SEQ ID NO: 1465 - DNA, 70 bp, Artificial Sequence
  Description of Artificial Sequence: Synthetic probe
aaaactgaagataagacaaaactcttcagcttcccgatatccgacggtagtgtaggggaccatgcagagt

SEQ ID NO: 1466 - DNA, 70 bp, Artificial Sequence
  Description of Artificial Sequence: Synthetic probe
ggttagaagaagtttcattagccttcagcttcccgatatccgacggtagtgtggttttccaaaagcattg

SEQ ID NO: 1467 - DNA, 70 bp, Artificial Sequence
  Description of Artificial Sequence: Synthetic probe
agtctgcaagtataattttaaaaacttcagcttcccgatatccgacggtagtgtaaggctgtccccacca

SEQ ID NO: 1468 - DNA, 70 bp, Artificial Sequence
  Description of Artificial Sequence: Synthetic probe
cagaatgaggtggtatattcttcagcttcccgatatccgacggtagtgtaattatagaaaggtttgcctt

SEQ ID NO: 1469 - DNA, 70 bp, Artificial Sequence
  Description of Artificial Sequence: Synthetic probe
tttgcgttttgtagacacttcagcttcccgatatccgacggtagtgtagtacattagatctgcagctaca

SEQ ID NO: 1470 - DNA, 70 bp, Artificial Sequence
  Description of Artificial Sequence: Synthetic probe
ccacacaaaaaattattgcacttcagcttcccgatatccgacggtagtgtaggcaaacaatatcatgaca

SEQ ID NO: 1471 - DNA, 70 bp, Artificial Sequence
  Description of Artificial Sequence: Synthetic probe
ttctttataatttgcaatttcttcagcttcccgatatccgacggtagtgttgtttctgcgtctttagatt

SEQ ID NO: 1472 - DNA, 70 bp, Artificial Sequence
  Description of Artificial Sequence: Synthetic probe
gagaggtgatggattttcactcttcagcttcccgatatccgacggtagtgtaagggaactgaaatccagc

SEQ ID NO: 1473 - DNA, 70 bp, Artificial Sequence
  Description of Artificial Sequence: Synthetic probe
aggcaaacaatatcatgaccttcagcttcccgatatccgacggtagtgtcgtattaggagcccattcaga

SEQ ID NO: 1474 - DNA, 70 bp, Artificial Sequence
  Description of Artificial Sequence: Synthetic probe
gccacaggagcctgccttcagcttcccgatatccgacggtagtgtaaatgaacaaaaaagcaaaagaaaa

SEQ ID NO: 1475 - DNA, 70 bp, Artificial Sequence
  Description of Artificial Sequence: Synthetic probe
acaaggtgttgggacaacttcagcttcccgatatccgacggtagtgtacccagaatgaggtggtatattt

SEQ ID NO: 1476 - DNA, 70 bp, Artificial Sequence
  Description of Artificial Sequence: Synthetic probe
tgattgtaagggacagggcttcagcttcccgatatccgacggtagtgtactttgcgttttgtagacataa

SEQ ID NO: 1477 - DNA, 70 bp, Artificial Sequence
  Description of Artificial Sequence: Synthetic probe
tcaatgtgtaaaccaaggcttcagcttcccgatatccgacggtagtgtccttctttataatttgcaattt

SEQ ID NO: 1478 - DNA, 70 bp, Artificial Sequence
  Description of Artificial Sequence: Synthetic probe
ttaccatcatccccattgacttcagcttcccgatatccgacggtagtgttgagaggtgatggattttcac

SEQ ID NO: 1479 - DNA, 70 bp, Artificial Sequence
  Description of Artificial Sequence: Synthetic probe
cagctgtggcctttagtcacttcagcttcccgatatccgacggtagtgtagtactttcaaacctattata

SEQ ID NO: 1480 - DNA, 70 bp, Artificial Sequence
  Description of Artificial Sequence: Synthetic probe
gatcaatttgatgggtaattcacttcagcttcccgatatccgacggtagtgttgctgagtactcagcacc

SEQ ID NO: 1481 - DNA, 70 bp, Artificial Sequence
  Description of Artificial Sequence: Synthetic probe
gaaaaaaaaagttgacctgggcttcagcttcccgatatccgacggtagtgtcagaggcctagtgatctgt

SEQ ID NO: 1482 - DNA, 70 bp, Artificial Sequence
  Description of Artificial Sequence: Synthetic probe
gcttggtgacagccagacttcagcttcccgatatccgacggtagtgtgctgtcattctctgctttttcct

SEQ ID NO: 1483 - DNA, 70 bp, Artificial Sequence
  Description of Artificial Sequence: Synthetic probe
aagatgatacagtgatacccttcagcttcccgatatccgacggtagtgtgctttctggaggacagcaggt

SEQ ID NO: 1484 - DNA, 70 bp, Artificial Sequence
  Description of Artificial Sequence: Synthetic probe
atcccagatttaatataattttcacttcagcttcccgatatccgacggtagtgtaggaagggtcagttcc

SEQ ID NO: 1485 - DNA, 70 bp, Artificial Sequence
  Description of Artificial Sequence: Synthetic probe
gatcttcccttggtctggccacttcagcttcccgatatccgacggtagtgtgtgcatgccccatcccctg

SEQ ID NO: 1486 - DNA, 70 bp, Artificial Sequence
  Description of Artificial Sequence: Synthetic probe
tttgggatcagcgatggtgccttcagcttcccgatatccgacggtagtgtgcctgtcctgcagcattggg

SEQ ID NO: 1487 - DNA, 70 bp, Artificial Sequence
  Description of Artificial Sequence: Synthetic probe
gccgggctgggctcagccacttcagcttcccgatatccgacggtagtgtgcccgtgctctgaccttctgt

SEQ ID NO: 1488 - DNA, 70 bp, Artificial Sequence
  Description of Artificial Sequence: Synthetic probe
atgggccacagctagtatccgaacttcagcttcccgatatccgacggtagtgtgatgagggcattgacgt

SEQ ID NO: 1489 - DNA, 70 bp, Artificial Sequence
  Description of Artificial Sequence: Synthetic probe
tgccaccccatccccagcttcagcttcccgatatccgacggtagtgtttcagcaccggcttcagggagct

SEQ ID NO: 1490 - DNA, 70 bp, Artificial Sequence
  Description of Artificial Sequence: Synthetic probe
gtggcccccaacccagacacactcttcagcttcccgatatccgacggtagtgtgcacgctcaggttctgg

SEQ ID NO: 1491 - DNA, 70 bp, Artificial Sequence
  Description of Artificial Sequence: Synthetic probe
tccttggactcttccccaccttcagcttcccgatatccgacggtagtgtggatcttcccttggtctggcc

SEQ ID NO: 1492 - DNA, 70 bp, Artificial Sequence
  Description of Artificial Sequence: Synthetic probe
ccctgagcctctcacccaggcttcagcttcccgatatccgacggtagtgttttgggatcagcgatggtgc

SEQ ID NO: 1493 - DNA, 70 bp, Artificial Sequence
  Description of Artificial Sequence: Synthetic probe
ctcgtagctctctgcctcggttcttcagcttcccgatatccgacggtagtgtcgggctgggctcagccac

SEQ ID NO: 1494 - DNA, 70 bp, Artificial Sequence
  Description of Artificial Sequence: Synthetic probe
aggagcccatggatgcgccttcagcttcccgatatccgacggtagtgtgcatgggccacagctagtatcc

SEQ ID NO: 1495 - DNA, 70 bp, Artificial Sequence
  Description of Artificial Sequence: Synthetic probe
tgaagaagctgacgtggcccacttcagcttcccgatatccgacggtagtgtcccagtgccctcgcccgga

SEQ ID NO: 1496 - DNA, 70 bp, Artificial Sequence
  Description of Artificial Sequence: Synthetic probe
agtctgtggacagaggcacttcagcttcccgatatccgacggtagtgttcccctcacctcactagagctt

SEQ ID NO: 1497 - DNA, 70 bp, Artificial Sequence
  Description of Artificial Sequence: Synthetic probe
ggccagggtggcccagcttcagcttcccgatatccgacggtagtgtgacggtagatcggaccacactgga

SEQ ID NO: 1498 - DNA, 70 bp, Artificial Sequence
  Description of Artificial Sequence: Synthetic probe
ccctcccacactggaaacgctccttcagcttcccgatatccgacggtagtgtaacagcggtgtgaccaag

SEQ ID NO: 1499 - DNA, 70 bp, Artificial Sequence
  Description of Artificial Sequence: Synthetic probe
actggaagggaaatgagagggccttcagcttcccgatatccgacggtagtgtagagggagagggaggcaa

SEQ ID NO: 1500 - DNA, 70 bp, Artificial Sequence
  Description of Artificial Sequence: Synthetic probe
cagggagcaggctcctaagagcttcagcttcccgatatccgacggtagtgtcggagggcgagaagtcggc

SEQ ID NO: 1501 - DNA, 70 bp, Artificial Sequence
  Description of Artificial Sequence: Synthetic probe
ttttagttggagacaccttcatccttcagcttcccgatatccgacggtagtgtagaagctgacgtggccc

SEQ ID NO: 1502 - DNA, 70 bp, Artificial Sequence
  Description of Artificial Sequence: Synthetic probe
ccccacagtcatctcatggacttcagcttcccgatatccgacggtagtgtagtctgtggacagaggcaca

SEQ ID NO: 1503 - DNA, 70 bp, Artificial Sequence
  Description of Artificial Sequence: Synthetic probe
ccccaacaagttcaggacttcacttcagcttcccgatatccgacggtagtgtccagggtggcccagggtg

SEQ ID NO: 1504 - DNA, 70 bp, Artificial Sequence
  Description of Artificial Sequence: Synthetic probe
tggagagcaggggctgctcttcagcttcccgatatccgacggtagtgtgtccctcccacactggaaacgc

SEQ ID NO: 1505 - DNA, 70 bp, Artificial Sequence
  Description of Artificial Sequence: Synthetic probe
caagagctacataatggatcccttcagcttcccgatatccgacggtagtgtgttggtacttctgtaataa

SEQ ID NO: 1506 - DNA, 70 bp, Artificial Sequence
  Description of Artificial Sequence: Synthetic probe
gtaacttatttttgaagacacttcagcttcccgatatccgacggtagtgtaggattctctgtttatacat

SEQ ID NO: 1507 - DNA, 70 bp, Artificial Sequence
  Description of Artificial Sequence: Synthetic probe
aaaagtctaaaacaacctttcttcagcttcccgatatccgacggtagtgtaaccttacttatatctcaag

SEQ ID NO: 1508 - DNA, 70 bp, Artificial Sequence
  Description of Artificial Sequence: Synthetic probe
ttttaaaaaccaatggcaaaactcttcagcttcccgatatccgacggtagtgttttttcaggtgtgattg

SEQ ID NO: 1509 - DNA, 70 bp, Artificial Sequence
  Description of Artificial Sequence: Synthetic probe
atttttaaagccaatttaaaacttcagcttcccgatatccgacggtagtgttgagataatttcttcataa

SEQ ID NO: 1510 - DNA, 70 bp, Artificial Sequence
  Description of Artificial Sequence: Synthetic probe
attgtattcagcacacaacttcagcttcccgatatccgacggtagtgtgaagacacagttcccatattaa

SEQ ID NO: 1511 - DNA, 70 bp, Artificial Sequence
  Description of Artificial Sequence: Synthetic probe
tgttggtacttctgtaataacttcagcttcccgatatccgacggtagtgtgaccttagaacagtaataaa

SEQ ID NO: 1512 - DNA, 70 bp, Artificial Sequence
  Description of Artificial Sequence: Synthetic probe
aggattctctgtttatacatgcttcagcttcccgatatccgacggtagtgtagcaagtaaaatctacatt

SEQ ID NO: 1513 - DNA, 70 bp, Artificial Sequence
  Description of Artificial Sequence: Synthetic probe
aaccttacttatatctcaacttcagcttcccgatatccgacggtagtgtactatttagctaaaatatgaa

SEQ ID NO: 1514 - DNA, 70 bp, Artificial Sequence
  Description of Artificial Sequence: Synthetic probe
aaatttttcaggtgtgacttcagcttcccgatatccgacggtagtgtcaacaaaatgtatatccatatta

SEQ ID NO: 1515 - DNA, 70 bp, Artificial Sequence
  Description of Artificial Sequence: Synthetic probe
atacatacacatacacacaccttcagcttcccgatatccgacggtagtgtccatgatccattacactgta

SEQ ID NO: 1516 - DNA, 70 bp, Artificial Sequence
  Description of Artificial Sequence: Synthetic probe
cagtaaagactgaatacataccttcagcttcccgatatccgacggtagtgtcaattagtttgaaaagcac

SEQ ID NO: 1517 - DNA, 70 bp, Artificial Sequence; identical to SEQ ID NO: 1144
  Description of Artificial Sequence: Synthetic probe

SEQ ID NO: 1518 - DNA, 70 bp, Artificial Sequence; identical to SEQ ID NO: 1145
  Description of Artificial Sequence: Synthetic probe

SEQ ID NO: 1519 - DNA, 70 bp, Artificial Sequence; identical to SEQ ID NO: 1146
  Description of Artificial Sequence: Synthetic probe

SEQ ID NO: 1520 - DNA, 70 bp, Artificial Sequence; identical to SEQ ID NO: 1147
  Description of Artificial Sequence: Synthetic probe

SEQ ID NO: 1521 - DNA, 70 bp, Artificial Sequence
  Description of Artificial Sequence: Synthetic probe
tatcaagttaaagattttttaacttcagcttcccgatatccgacggtagtgtttcaatagatgcttgttt

SEQ ID NO: 1522 - DNA, 70 bp, Artificial Sequence
  Description of Artificial Sequence: Synthetic probe
atctaaaactaagatatttgccccttcagcttcccgatatccgacggtagtgttaaaagatgagtttgtc

SEQ ID NO: 1523 - DNA, 70 bp, Artificial Sequence
  Description of Artificial Sequence: Synthetic probe
tagcatacggtttctagaggaccttcagcttcccgatatccgacggtagtgtacacacacacacacacac

SEQ ID NO: 1524 - DNA, 70 bp, Artificial Sequence
  Description of Artificial Sequence: Synthetic probe
tattactttatagtacataattcttcagcttcccgatatccgacggtagtgtccccaaatccctgttaaa

SEQ ID NO: 1525 - DNA, 70 bp, Artificial Sequence; identical to SEQ ID NO: 1138
  Description of Artificial Sequence: Synthetic probe

SEQ ID NO: 1526 - DNA, 70 bp, Artificial Sequence; identical to SEQ ID NO: 1139
  Description of Artificial Sequence: Synthetic probe

SEQ ID NO: 1527 - DNA, 70 bp, Artificial Sequence; identical to SEQ ID NO: 1142
  Description of Artificial Sequence: Synthetic probe

SEQ ID NO: 1528 - DNA, 70 bp, Artificial Sequence; identical to SEQ ID NO: 1143
  Description of Artificial Sequence: Synthetic probe

SEQ ID NO: 1529 - DNA, 70 bp, Artificial Sequence
  Description of Artificial Sequence: Synthetic probe
cttatacccactgaatgacttcagcttcccgatatccgacggtagtgtcttgtaattatttttcattacc

SEQ ID NO: 1530 - DNA, 70 bp, Artificial Sequence
  Description of Artificial Sequence: Synthetic probe
gaaacatagtattgagaatatgccttcagcttcccgatatccgacggtagtgtactgcaacagatggaag

SEQ ID NO: 1531 - DNA, 70 bp, Artificial Sequence
  Description of Artificial Sequence: Synthetic probe
tcatatatctctattaattattaacttcagcttcccgatatccgacggtagtgtgggtgtcttactcgcc

SEQ ID NO: 1532 - DNA, 70 bp, Artificial Sequence
  Description of Artificial Sequence: Synthetic probe
gattataattgaatcttttatgtgcttcagcttcccgatatccgacggtagtgtaccatgaatagaacat

SEQ ID NO: 1533 - DNA, 70 bp, Artificial Sequence
  Description of Artificial Sequence: Synthetic probe
caactgaaatttagatccacaaggcttcagcttcccgatatccgacggtagtgtttggtgctagctgtaa

SEQ ID NO: 1534 - DNA, 70 bp, Artificial Sequence
  Description of Artificial Sequence: Synthetic probe
gtctccagaaatcaagatgacacttcagcttcccgatatccgacggtagtgttatgttgaaagttaaaca

SEQ ID NO: 1535 - DNA, 70 bp, Artificial Sequence
  Description of Artificial Sequence: Synthetic probe
tgtaattatttttcattacccttcagcttcccgatatccgacggtagtgtatgttggatcaagataaatc

SEQ ID NO: 1536 - DNA, 70 bp, Artificial Sequence
  Description of Artificial Sequence: Synthetic probe
aatactgcaacagatggaagaccttcagcttcccgatatccgacggtagtgtttcaatgcacctcctccc

SEQ ID NO: 1537 - DNA, 70 bp, Artificial Sequence
  Description of Artificial Sequence: Synthetic probe
ttcagggtgtcttactcgcccttcagcttcccgatatccgacggtagtgtaaatctaagtcagtgttttc

SEQ ID NO: 1538 - DNA, 70 bp, Artificial Sequence
  Description of Artificial Sequence: Synthetic probe
ttgtaccatgaatagaacacttcagcttcccgatatccgacggtagtgtgcaaataagcttttaagacat

SEQ ID NO: 1539 - DNA, 70 bp, Artificial Sequence
  Description of Artificial Sequence: Synthetic probe
gggaacttaaaaaattaccaccttcagcttcccgatatccgacggtagtgttgtacctgaaaaagactaa

SEQ ID NO: 1540 - DNA, 70 bp, Artificial Sequence
  Description of Artificial Sequence: Synthetic probe
ctttttttacttggctaccacttcagcttcccgatatccgacggtagtgtacacaaaatgtaatttcata

SEQ ID NO: 1541 - DNA, 70 bp, Artificial Sequence
  Description of Artificial Sequence: Synthetic probe
tgttattttattaatgagttacccttcagcttcccgatatccgacggtagtgtgaaaacattgcaaataa

SEQ ID NO: 1542 - DNA, 70 bp, Artificial Sequence
  Description of Artificial Sequence: Synthetic probe
tgccattctttgaatagatacttcagcttcccgatatccgacggtagtgtggactcctgcctgtgaaata

SEQ ID NO: 1543 - DNA, 70 bp, Artificial Sequence
  Description of Artificial Sequence: Synthetic probe
gttaaaaagctttttttcaccttcagcttcccgatatccgacggtagtgtgcttgtaacaagatgagtga

SEQ ID NO: 1544 - DNA, 70 bp, Artificial Sequence
  Description of Artificial Sequence: Synthetic probe
aataatcatatcacaaatgtcacttcagcttcccgatatccgacggtagtgtcgaagtgtccatagtcct

SEQ ID NO: 1545 - DNA, 70 bp, Artificial Sequence
  Description of Artificial Sequence: Synthetic probe
ttgtacctgaaaaagactaaattagcttcagcttcccgatatccgacggtagtgtgtaaggctgccgtcc

SEQ ID NO: 1546 - DNA, 70 bp, Artificial Sequence
  Description of Artificial Sequence: Synthetic probe
acacaaaatgtaatttcataacttcagcttcccgatatccgacggtagtgtttcagagctttgtggaaca

SEQ ID NO: 1547 - DNA, 70 bp, Artificial Sequence
  Description of Artificial Sequence: Synthetic probe
atagaaaacattgcaaataacacttcagcttcccgatatccgacggtagtgtaagaaccagttggcagta

SEQ ID NO: 1548 - DNA, 70 bp, Artificial Sequence
  Description of Artificial Sequence: Synthetic probe
ggactcctgcctgtgaaatacttcagcttcccgatatccgacggtagtgttggaaccagcgcagtgttga

SEQ ID NO: 1549 - DNA, 70 bp, Artificial Sequence
  Description of Artificial Sequence: Synthetic probe
gtgtctgtttgaggttcttcagcttcccgatatccgacggtagtgtgtctccacatgcccagtttctatt

SEQ ID NO: 1550 - DNA, 70 bp, Artificial Sequence
  Description of Artificial Sequence: Synthetic probe
cacagttgtgtcagaagcacttcagcttcccgatatccgacggtagtgttccttaaacctgtcttgtaac

SEQ ID NO: 1551 - DNA, 70 bp, Artificial Sequence
  Description of Artificial Sequence: Synthetic probe
tcttggccccataccatcagtacaacttcagcttcccgatatccgacggtagtgttgctcctgggagtag

SEQ ID NO: 1552 - DNA, 70 bp, Artificial Sequence
  Description of Artificial Sequence: Synthetic probe
attgctactaaaaacatcctcctcttcagcttcccgatatccgacggtagtgtaccctagggtgtggctc

SEQ ID NO: 1553 - DNA, 70 bp, Artificial Sequence
  Description of Artificial Sequence: Synthetic probe
gcaagtgtatttacgtaatacttcagcttcccgatatccgacggtagtgtggtgaggtctaagtgatgac

SEQ ID NO: 1554 - DNA, 70 bp, Artificial Sequence
  Description of Artificial Sequence: Synthetic probe
aatcacagcttggtaagcacttcagcttcccgatatccgacggtagtgtgtacctgtccttggctcttct

SEQ ID NO: 1555 - DNA, 70 bp, Artificial Sequence
  Description of Artificial Sequence: Synthetic probe
agcaatagatggctctgccctgacttcagcttcccgatatccgacggtagtgtcaacctgcccagggcct

SEQ ID NO: 1556 - DNA, 70 bp, Artificial Sequence
  Description of Artificial Sequence: Synthetic probe
tttatgcccagccctggctcctgcccttcagcttcccgatatccgacggtagtgtttcatccacgttcac

SEQ ID NO: 1557 - DNA, 70 bp, Artificial Sequence
  Description of Artificial Sequence: Synthetic probe
ctccctgctcctgggagtagattcttcagcttcccgatatccgacggtagtgtacagggcagtaacggca

SEQ ID NO: 1558 - DNA, 70 bp, Artificial Sequence
  Description of Artificial Sequence: Synthetic probe
ccaaccctagggtgtggctccacttcagcttcccgatatccgacggtagtgtcctcaggagtcagatgca

SEQ ID NO: 1559 - DNA, 70 bp, Artificial Sequence
  Description of Artificial Sequence: Synthetic probe
ggtgaggtctaagtgatgacttcagcttcccgatatccgacggtagtgtggtgtctgtttgaggttgcta

SEQ ID NO: 1560 - DNA, 70 bp, Artificial Sequence
  Description of Artificial Sequence: Synthetic probe
tacctgtccttggctcttctggcaccttcagcttcccgatatccgacggtagtgtttgtgtcagaagcaa

SEQ ID NO: 1561 - DNA, 70 bp, Artificial Sequence
  Description of Artificial Sequence: Synthetic probe
tggcttaggagttggacttccttcagcttcccgatatccgacggtagtgtagcaatagatggctctgccc

SEQ ID NO: 1562 - DNA, 70 bp, Artificial Sequence
  Description of Artificial Sequence: Synthetic probe
ctcagccctccctctaagatatatccttcagcttcccgatatccgacggtagtgtgcccagccctggctc

SEQ ID NO: 1563 - DNA, 70 bp, Artificial Sequence
  Description of Artificial Sequence: Synthetic probe
aagggtagaccaccagcagccttcagcttcccgatatccgacggtagtgttggcaaaggtgcccttgagg

SEQ ID NO: 1564 - DNA, 70 bp, Artificial Sequence
  Description of Artificial Sequence: Synthetic probe
ggtgggaaaatagaccaataggcagcttcagcttcccgatatccgacggtagtgtgagccaggccatcac

SEQ ID NO: 1565 - DNA, 70 bp, Artificial Sequence
  Description of Artificial Sequence: Synthetic probe
agagagtcagtgcctatcagaaacccttcagcttcccgatatccgacggtagtgtgagcactttcttgcc

SEQ ID NO: 1566 - DNA, 70 bp, Artificial Sequence
  Description of Artificial Sequence: Synthetic probe
caagagtcttctctgtctccacatcttcagcttcccgatatccgacggtagtgtcaccttagggttgccc

SEQ ID NO: 1567 - DNA, 70 bp, Artificial Sequence
  Description of Artificial Sequence: Synthetic probe
cccagtttctattggtctccttaaacttcagcttcccgatatccgacggtagtgtcaggagtggacagat

SEQ ID NO: 1568 - DNA, 70 bp, Artificial Sequence
  Description of Artificial Sequence: Synthetic probe
cctgtcttgtaaccttgacttcagcttcccgatatccgacggtagtgtcaaaggactcaaagaacctctg

SEQ ID NO: 1569 - DNA, 70 bp, Artificial Sequence
  Description of Artificial Sequence: Synthetic probe
ctgcccagggcctcacttcagcttcccgatatccgacggtagtgtggtccaagggtagaccaccagcagc

SEQ ID NO: 1570 - DNA, 70 bp, Artificial Sequence
  Description of Artificial Sequence: Synthetic probe
catccacgttcaccttgccttcagcttcccgatatccgacggtagtgtagggtgggaaaatagaccaata

SEQ ID NO: 1571 - DNA, 70 bp, Artificial Sequence
  Description of Artificial Sequence: Synthetic probe
ggcagtaacggcagacttcagcttcccgatatccgacggtagtgtggcagagagagtcagtgcctatcag

SEQ ID NO: 1572 - DNA, 70 bp, Artificial Sequence
  Description of Artificial Sequence: Synthetic probe
aagcagaatggtagctggattgtagcttcagcttcccgatatccgacggtagtgtaattctttgccaaag

SEQ ID NO: 1573 - DNA, 70 bp, Artificial Sequence
  Description of Artificial Sequence: Synthetic probe
ctgctattagcaatatgaaacctctcttcagcttcccgatatccgacggtagtgtgcacacagaccagca

SEQ ID NO: 1574 - DNA, 70 bp, Artificial Sequence
  Description of Artificial Sequence: Synthetic probe
tttttaaaattacaaatgcaaaattcttcagcttcccgatatccgacggtagtgtccttaacccagaaat

SEQ ID NO: 1575 - DNA, 70 bp, Artificial Sequence
  Description of Artificial Sequence: Synthetic probe
accctgatttggtcaatcttcagcttcccgatatccgacggtagtgttcactgttattctttagaatggt

SEQ ID NO: 1576 - DNA, 70 bp, Artificial Sequence
  Description of Artificial Sequence: Synthetic probe
tacatcagttacaatttatatgcagcttcagcttcccgatatccgacggtagtgtgagctgtgggaggaa

SEQ ID NO: 1577 - DNA, 70 bp, Artificial Sequence
  Description of Artificial Sequence: Synthetic probe
aaatatttatatgcagacttcagcttcccgatatccgacggtagtgttaagaggtatgaacatgattagc

SEQ ID NO: 1578 - DNA, 70 bp, Artificial Sequence
  Description of Artificial Sequence: Synthetic probe
tattgccttaacccagaaacttcagcttcccgatatccgacggtagtgtgggcctagcttggactcagaa

SEQ ID NO: 1579 - DNA, 70 bp, Artificial Sequence
  Description of Artificial Sequence: Synthetic probe
ctgttattctttagaatggtgccttcagcttcccgatatccgacggtagtgtgccttatcccaaccataa

SEQ ID NO: 1580 - DNA, 70 bp, Artificial Sequence
  Description of Artificial Sequence: Synthetic probe
gaggcatgatacattgtatcacttcagcttcccgatatccgacggtagtgtagcagaatggtagctggat

SEQ ID NO: 1581 - DNA, 70 bp, Artificial Sequence
  Description of Artificial Sequence: Synthetic probe
tgccctgaaagaaagagacttcagcttcccgatatccgacggtagtgtagctgctattagcaatatgaaa

SEQ ID NO: 1582 - DNA, 70 bp, Artificial Sequence
  Description of Artificial Sequence: Synthetic probe
aagtattagaaataagataaacaacttcagcttcccgatatccgacggtagtgttcagttacaatttata

SEQ ID NO: 1583 - DNA, 70 bp, Artificial Sequence
  Description of Artificial Sequence: Synthetic probe
aaagtatattaaaagaagaaagcacttcagcttcccgatatccgacggtagtgtatttatatgcagagat

SEQ ID NO: 1584 - DNA, 70 bp, Artificial Sequence
  Description of Artificial Sequence: Synthetic probe
agttctaattattgggtctgtgcttcagcttcccgatatccgacggtagtgtccccccaattctgaaaca

SEQ ID NO: 1585 - DNA, 70 bp, Artificial Sequence
  Description of Artificial Sequence: Synthetic probe
ctcacagtctagccagagacccttcagcttcccgatatccgacggtagtgtccggggtatggggaaagag

SEQ ID NO: 1586 - DNA, 70 bp, Artificial Sequence
  Description of Artificial Sequence: Synthetic probe
tgacatcttccccacctgccttcagcttcccgatatccgacggtagtgtttcatattgagagagatgagg

SEQ ID NO: 1587 - DNA, 70 bp, Artificial Sequence
  Description of Artificial Sequence: Synthetic probe
tttgggtggagggtaaaagcacttcagcttcccgatatccgacggtagtgtagaagttctcacgggaaca

SEQ ID NO: 1588 - DNA, 70 bp, Artificial Sequence
  Description of Artificial Sequence: Synthetic probe
aatcctggtcctcctgtgctcttcagcttcccgatatccgacggtagtgtgggatccgtggagttgatca

SEQ ID NO: 1589 - DNA, 70 bp, Artificial Sequence
  Description of Artificial Sequence: Synthetic probe
aacatgagaggtcaacacttgtcttcagcttcccgatatccgacggtagtgtaccagccactggagctgt

SEQ ID NO: 1590 - DNA, 70 bp, Artificial Sequence
  Description of Artificial Sequence: Synthetic probe
aaccccccaattctgaaacacttcagcttcccgatatccgacggtagtgtcgatcctcagcagcctgaag

SEQ ID NO: 1591 - DNA, 70 bp, Artificial Sequence
  Description of Artificial Sequence: Synthetic probe
accggggtatggggaaagagcttcagcttcccgatatccgacggtagtgtactactggccctcactttgt

SEQ ID NO: 1592 - DNA, 70 bp, Artificial Sequence
  Description of Artificial Sequence: Synthetic probe
tcatattgagagagatgaggcggacttcagcttcccgatatccgacggtagtgtccccagcaccaccgtg

SEQ ID NO: 1593 - DNA, 70 bp, Artificial Sequence
  Description of Artificial Sequence: Synthetic probe
cagaagttctcacgggaacaacttcagcttcccgatatccgacggtagtgtgctccagctcaacaggagc

SEQ ID NO: 1594 - DNA, 70 bp, Artificial Sequence
  Description of Artificial Sequence: Synthetic probe
gggatccgtggagttgacttcagcttcccgatatccgacggtagtgtaggaaaataaaacttctgtgccc

SEQ ID NO: 1595 - DNA, 70 bp, Artificial Sequence
  Description of Artificial Sequence: Synthetic probe
ccaccagccactggagctcttcagcttcccgatatccgacggtagtgtcagggaacacttgttgggaatg

SEQ ID NO: 1596 - DNA, 70 bp, Artificial Sequence
  Description of Artificial Sequence: Synthetic probe
cgatcctcagcagcctgacttcagcttcccgatatccgacggtagtgtcaacagtgaccatgagctgaat

SEQ ID NO: 1597 - DNA, 70 bp, Artificial Sequence
  Description of Artificial Sequence: Synthetic probe
catgagaaccgaaagggccttcagcttcccgatatccgacggtagtgtagaaattgctcagagtcatagg

SEQ ID NO: 1598 - DNA, 70 bp, Artificial Sequence
  Description of Artificial Sequence: Synthetic probe
ccaacccacactgcctcacttcagcttcccgatatccgacggtagtgtttcatatggttcacaccgattt

SEQ ID NO: 1599 - DNA, 70 bp, Artificial Sequence
  Description of Artificial Sequence: Synthetic probe
tccgtggaaaagcccgtaccttcagcttcccgatatccgacggtagtgtagtcctgcagtaaacacggca

SEQ ID NO: 1600 - DNA, 70 bp, Artificial Sequence
  Description of Artificial Sequence: Synthetic probe
tcacccataaacttgtccacttcagcttcccgatatccgacggtagtgttctcaaatataattcctcgca

SEQ ID NO: 1601 - DNA, 70 bp, Artificial Sequence
  Description of Artificial Sequence: Synthetic probe
gccctgaggcattgacgcttcagcttcccgatatccgacggtagtgtactgggaagagtctgcctaaagc

SEQ ID NO: 1602 - DNA, 70 bp, Artificial Sequence
  Description of Artificial Sequence: Synthetic probe
tcccgttttgcagaggaccttcagcttcccgatatccgacggtagtgtaaataactcaaatgcaattgct

SEQ ID NO: 1603 - DNA, 70 bp, Artificial Sequence
  Description of Artificial Sequence: Synthetic probe
ttgatccacaacggtgtccccttcagcttcccgatatccgacggtagtgtcatgagaaccgaaagggcct

SEQ ID NO: 1604 - DNA, 70 bp, Artificial Sequence
  Description of Artificial Sequence: Synthetic probe
ctgtcacaactccgagggccttcagcttcccgatatccgacggtagtgtcccaacccacactgcctcaca

SEQ ID NO: 1605 - DNA, 70 bp, Artificial Sequence
  Description of Artificial Sequence: Synthetic probe
aaaactgaacactccggccacttcagcttcccgatatccgacggtagtgttccgtggaaaagcccgtact

SEQ ID NO: 1606 - DNA, 70 bp, Artificial Sequence
  Description of Artificial Sequence: Synthetic probe
aaaatgattttcttctgttggccttcagcttcccgatatccgacggtagtgtacccataaacttgtccag

SEQ ID NO: 1607 - DNA, 70 bp, Artificial Sequence
  Description of Artificial Sequence: Synthetic probe
gcatgatgagaaacggcttccttcagcttcccgatatccgacggtagtgtgccctgaggcattgacgagc

SEQ ID NO: 1608 - DNA, 70 bp, Artificial Sequence
  Description of Artificial Sequence: Synthetic probe
gggcgaggttcaaaaacacttcagcttcccgatatccgacggtagtgtgctcccgttttgcagaggacag

SEQ ID NO: 1609 - DNA, 70 bp, Artificial Sequence
  Description of Artificial Sequence: Synthetic probe
tgtgagcaatgggaagggaccttcagcttcccgatatccgacggtagtgtttgatccacaacggtgtccc

SEQ ID NO: 1610 - DNA, 70 bp, Artificial Sequence
  Description of Artificial Sequence: Synthetic probe
ctttgactgcatttattaccttcagcttcccgatatccgacggtagtgtgctgtcacaactccgagggca

SEQ ID NO: 1611 - DNA, 70 bp, Artificial Sequence
  Description of Artificial Sequence: Synthetic probe
tgaacggacagctcccagcttcagcttcccgatatccgacggtagtgtgcaaaactgaacactccggcca

SEQ ID NO: 1612 - DNA, 70 bp, Artificial Sequence
  Description of Artificial Sequence: Synthetic probe
ggcaacttcaccatcgcttcagcttcccgatatccgacggtagtgtgcaaaaaatgattttcttctgttg

SEQ ID NO: 1613 - DNA, 70 bp, Artificial Sequence
  Description of Artificial Sequence: Synthetic probe
gtttgcctttcagtacattcttcagcttcccgatatccgacggtagtgtactttccagcctgtatcctta

SEQ ID NO: 1614 - DNA, 70 bp, Artificial Sequence
  Description of Artificial Sequence: Synthetic probe
gcagctacattagttgtcttcagcttcccgatatccgacggtagtgtacgtaatttgtaaacattgtcac

SEQ ID NO: 1615 - DNA, 70 bp, Artificial Sequence
  Description of Artificial Sequence: Synthetic probe
ctttagattttgcaaaaggcttcagcttcccgatatccgacggtagtgtggtcctgatgctttaatatat

SEQ ID NO: 1616 - DNA, 70 bp, Artificial Sequence
  Description of Artificial Sequence: Synthetic probe
aaatccagcaagtcgtcttcagcttcccgatatccgacggtagtgtcagactaaaaggatatgcaaaatt

SEQ ID NO: 1617 - DNA, 70 bp, Artificial Sequence
  Description of Artificial Sequence: Synthetic probe
ccattcagaaaatgaacaacttcagcttcccgatatccgacggtagtgtacatctaaaagtgaccaaagc

SEQ ID NO: 1618 - DNA, 70 bp, Artificial Sequence
  Description of Artificial Sequence: Synthetic probe
aaaagaaaatgacccagacttcagcttcccgatatccgacggtagtgttctactcccttgtaaaattata

SEQ ID NO: 1619 - DNA, 70 bp, Artificial Sequence
  Description of Artificial Sequence: Synthetic probe
ggtatatttttcactttgcgcttcagcttcccgatatccgacggtagtgtgtttgcctttcagtacatta

SEQ ID NO: 1620 - DNA, 70 bp, Artificial Sequence
  Description of Artificial Sequence: Synthetic probe
tagacataagtcccttcttcttcagcttcccgatatccgacggtagtgttgcagctacattagttgtttc

SEQ ID NO: 1621 - DNA, 70 bp, Artificial Sequence
  Description of Artificial Sequence: Synthetic probe
ttgcaattttttctgagaggcttcagcttcccgatatccgacggtagtgtctttagattttgcaaaaggg

SEQ ID NO: 1622 - DNA, 70 bp, Artificial Sequence
  Description of Artificial Sequence: Synthetic probe
gattttcacttcagaggcacttcagcttcccgatatccgacggtagtgtgaaatccagcaagtcgtatta

SEQ ID NO: 1623 - DNA, 70 bp, Artificial Sequence
  Description of Artificial Sequence: Synthetic probe
atcatgacaagacagccacttcagcttcccgatatccgacggtagtgtgcccattcagaaaatgaacaaa

SEQ ID NO: 1624 - DNA, 70 bp, Artificial Sequence
  Description of Artificial Sequence: Synthetic probe
ctgcaacagaagaaacaacttcagcttcccgatatccgacggtagtgtgcaaaagaaaatgacccagaat

SEQ ID NO: 1625 - DNA, 70 bp, Artificial Sequence
  Description of Artificial Sequence: Synthetic probe
ggcccgcgcggttctaccttcagcttcccgatatccgacggtagtgtgtacacacgactccagctctgca

SEQ ID NO: 1626 - DNA, 70 bp, Artificial Sequence
  Description of Artificial Sequence: Synthetic probe
gtcatcacccgggagcagcgcttcagcttcccgatatccgacggtagtgtccctcaccttggccaaggag

SEQ ID NO: 1627 - DNA, 70 bp, Artificial Sequence
  Description of Artificial Sequence: Synthetic probe
ctgcgcatgcacaggcgcacttcagcttcccgatatccgacggtagtgtggctcaacacgacctcaccta

SEQ ID NO: 1628 - DNA, 70 bp, Artificial Sequence
  Description of Artificial Sequence: Synthetic probe
gccgctccgccaaggtctcccttcagcttcccgatatccgacggtagtgtctgagcgggaccttccgtgc

SEQ ID NO: 1629 - DNA, 70 bp, Artificial Sequence
  Description of Artificial Sequence: Synthetic probe
actttcacctccgctgggcgcccttcagcttcccgatatccgacggtagtgtggttaagccgcgtaccgg

SEQ ID NO: 1630 - DNA, 70 bp, Artificial Sequence
  Description of Artificial Sequence: Synthetic probe
ccgctgtattttcctttccgccaatcttcagcttcccgatatccgacggtagtgtcccgcctccgccagc

SEQ ID NO: 1631 - DNA, 70 bp, Artificial Sequence
  Description of Artificial Sequence: Synthetic probe
cacacgactccagctctgcattttcttcagcttcccgatatccgacggtagtgtgggccaggggtggtgc

SEQ ID NO: 1632 - DNA, 70 bp, Artificial Sequence
  Description of Artificial Sequence: Synthetic probe
tgttttgtttttgagacagacttcagcttcccgatatccgacggtagtgtgtgataacttcagctttacc

SEQ ID NO: 1633 - DNA, 70 bp, Artificial Sequence
  Description of Artificial Sequence: Synthetic probe
gttgatgacattttcatttttgcttcagcttcccgatatccgacggtagtgttgcaaaccaagagtacat

SEQ ID NO: 1634 - DNA, 70 bp, Artificial Sequence
  Description of Artificial Sequence: Synthetic probe
tggaattctacctctcttcagcttcccgatatccgacggtagtgtttgtaagtttactattcttccccaa

SEQ ID NO: 1635 - DNA, 70 bp, Artificial Sequence
  Description of Artificial Sequence: Synthetic probe
ttttagtttgaaatctggtcttcagcttcccgatatccgacggtagtgtagttattttttattttacatt

SEQ ID NO: 1636 - DNA, 70 bp, Artificial Sequence
  Description of Artificial Sequence: Synthetic probe
atttaaggccagcaatttctcacttcagcttcccgatatccgacggtagtgtttcttagtaaagggtcgt

SEQ ID NO: 1637 - DNA, 70 bp, Artificial Sequence
  Description of Artificial Sequence: Synthetic probe
cctacataaattgataggcttagacttcagcttcccgatatccgacggtagtgtttcccagctcttctag

SEQ ID NO: 1638 - DNA, 70 bp, Artificial Sequence
  Description of Artificial Sequence: Synthetic probe
acagtgtataaatgttaaatacacacttcagcttcccgatatccgacggtagtgtttctacctctgggat

SEQ ID NO: 1639 - DNA, 70 bp, Artificial Sequence
  Description of Artificial Sequence: Synthetic probe
aagcagcttcaatactagacttcagcttcccgatatccgacggtagtgtattttagtttgaaatctggta

SEQ ID NO: 1640 - DNA, 70 bp, Artificial Sequence
  Description of Artificial Sequence: Synthetic probe
gtgataacttcagctttacccttcagcttcccgatatccgacggtagtgtgacaattatccaacttactt

SEQ ID NO: 1641 - DNA, 70 bp, Artificial Sequence
  Description of Artificial Sequence: Synthetic probe
aatgcaaaccaagagtacacttcagcttcccgatatccgacggtagtgttcaattttaaaattactgaaa

SEQ ID NO: 1642 - DNA, 70 bp, Artificial Sequence
  Description of Artificial Sequence: Synthetic probe
aattcttagtaaagggtcgtccttcagcttcccgatatccgacggtagtgtacttttcaaaatactgttt

SEQ ID NO: 1643 - DNA, 70 bp, Artificial Sequence
  Description of Artificial Sequence: Synthetic probe
tcaattcccagctcttcttcagcttcccgatatccgacggtagtgtgccaatacatattttaagcataaa

SEQ ID NO: 1644 - DNA, 70 bp, Artificial Sequence
  Description of Artificial Sequence: Synthetic probe
ctcttcaaaaatctatgaattcacttcagcttcccgatatccgacggtagtgtgcaactacatcaccaat

SEQ ID NO: 1645 - DNA, 70 bp, Artificial Sequence
  Description of Artificial Sequence: Synthetic probe
tcaccaaaaaatacatcaaatgcacttcagcttcccgatatccgacggtagtgtgctttgtgagccagca

SEQ ID NO: 1646 - DNA, 70 bp, Artificial Sequence
  Description of Artificial Sequence: Synthetic probe
cactgatggcacacaattgtcttcagcttcccgatatccgacggtagtgtttagcataatgataaaatgc

SEQ ID NO: 1647 - DNA, 70 bp, Artificial Sequence
  Description of Artificial Sequence: Synthetic probe
aagcaacttcagggtgtgtcttcagcttcccgatatccgacggtagtgtacaatatttcacagctgttaa

SEQ ID NO: 1648 - DNA, 70 bp, Artificial Sequence
  Description of Artificial Sequence: Synthetic probe
aactgctcttctgatttgcccttcagcttcccgatatccgacggtagtgtacaagggaaaaatatataag

SEQ ID NO: 1649 - DNA, 70 bp, Artificial Sequence
  Description of Artificial Sequence: Synthetic probe
gtaacaaaagtttccagtaaaccttcagcttcccgatatccgacggtagtgttcaacacagataatgcct

SEQ ID NO: 1650 - DNA, 70 bp, Artificial Sequence
  Description of Artificial Sequence: Synthetic probe
gctacttaccttcagttacattacttcagcttcccgatatccgacggtagtgttgcacagcaccaccagc

SEQ ID NO: 1651 - DNA, 70 bp, Artificial Sequence
  Description of Artificial Sequence: Synthetic probe
aacacaatgaatttctgaaatcacttcagcttcccgatatccgacggtagtgttgatggcacacaattgt

SEQ ID NO: 1652 - DNA, 70 bp, Artificial Sequence
  Description of Artificial Sequence: Synthetic probe
agatactaccacagaaatcaaacttcagcttcccgatatccgacggtagtgtgcaacttcagggtgtgtg

SEQ ID NO: 1653 - DNA, 70 bp, Artificial Sequence
  Description of Artificial Sequence: Synthetic probe
ccagcaactacatcaccaacttcagcttcccgatatccgacggtagtgtcaactgctcttctgatttgcc

SEQ ID NO: 1654 - DNA, 70 bp, Artificial Sequence
  Description of Artificial Sequence: Synthetic probe
ctctgctttgtgagccagcattgcttcagcttcccgatatccgacggtagtgtgttcagacttacctctt

SEQ ID NO: 1655 - DNA, 70 bp, Artificial Sequence
  Description of Artificial Sequence: Synthetic probe
cttcaacacagataatgcctcttcagcttcccgatatccgacggtagtgtactcacacattggcttaaaa

SEQ ID NO: 1656 - DNA, 70 bp, Artificial Sequence
  Description of Artificial Sequence: Synthetic probe
atgtgcacagcaccaccagcttcagcttcccgatatccgacggtagtgttctcaaccaccaatgtcattg

SEQ ID NO: 1657 - DNA, 70 bp, Artificial Sequence
  Description of Artificial Sequence: Synthetic probe
gcacatagaaggaaaggaaacttcagcttcccgatatccgacggtagtgtgcaaatgggaatttcccaac

SEQ ID NO: 1658 - DNA, 70 bp, Artificial Sequence
  Description of Artificial Sequence: Synthetic probe
tcccaagaagggaattgttcgccttcagcttcccgatatccgacggtagtgtttgtcttagctctgctgt

SEQ ID NO: 1659 - DNA, 70 bp, Artificial Sequence
  Description of Artificial Sequence: Synthetic probe
tccaagaatatgtgctcccacttcagcttcccgatatccgacggtagtgttccttctagaaatgatgcac

SEQ ID NO: 1660 - DNA, 70 bp, Artificial Sequence
  Description of Artificial Sequence: Synthetic probe
atctaccatttgttcagaaaacttcagcttcccgatatccgacggtagtgtcttcaccatgccatctgtg

SEQ ID NO: 1661 - DNA, 70 bp, Artificial Sequence
  Description of Artificial Sequence: Synthetic probe
aaagttctttccaatttgtaaacttcagcttcccgatatccgacggtagtgtgtctgtcgatttctgccc

SEQ ID NO: 1662 - DNA, 70 bp, Artificial Sequence
  Description of Artificial Sequence: Synthetic probe
aaaaagaatctacgtaactgccttcagcttcccgatatccgacggtagtgtccaagaatatgtgctccca

SEQ ID NO: 1663 - DNA, 70 bp, Artificial Sequence
  Description of Artificial Sequence: Synthetic probe
actcaataccctgtgacagtcttcagcttcccgatatccgacggtagtgttctctggttttacaatactc

SEQ ID NO: 1664 - DNA, 70 bp, Artificial Sequence
  Description of Artificial Sequence: Synthetic probe
gcaaatgggaatttcccaacttcagcttcccgatatccgacggtagtgttgctttctagaaatcttaatg

SEQ ID NO: 1665 - DNA, 70 bp, Artificial Sequence
  Description of Artificial Sequence: Synthetic probe
atttgtcttagctctgctcttcagcttcccgatatccgacggtagtgtggtggtttataattaataaaca

SEQ ID NO: 1666 - DNA, 70 bp, Artificial Sequence
  Description of Artificial Sequence: Synthetic probe
tcttcaccatgccatctgtgtcttcagcttcccgatatccgacggtagtgtgagcaacctcagactaaca

SEQ ID NO: 1667 - DNA, 70 bp, Artificial Sequence
  Description of Artificial Sequence: Synthetic probe
ctgtctgtcgatttctgccccttcagcttcccgatatccgacggtagtgtgccatattcaaagttttgct

SEQ ID NO: 1668 - DNA, 70 bp, Artificial Sequence
  Description of Artificial Sequence: Synthetic probe
aagtcaggaaaagcttaatagcttcagcttcccgatatccgacggtagtgttttaccatttctccagcac

SEQ ID NO: 1669 - DNA, 70 bp, Artificial Sequence
  Description of Artificial Sequence: Synthetic probe
atctgtttctttatcagttgaagacttcagcttcccgatatccgacggtagtgtttccaaagcaagagca

SEQ ID NO: 1670 - DNA, 70 bp, Artificial Sequence
  Description of Artificial Sequence: Synthetic probe
cttttagatcttaaaaacgcctcttcagcttcccgatatccgacggtagtgtagctatatcttcacagga

SEQ ID NO: 1671 - DNA, 70 bp, Artificial Sequence
  Description of Artificial Sequence: Synthetic probe
taggatagcaattgttgaggggacttcagcttcccgatatccgacggtagtgttaccggatgtgcatgac

SEQ ID NO: 1672 - DNA, 70 bp, Artificial Sequence
  Description of Artificial Sequence: Synthetic probe
ttccaaggcaaaaactacacttcagcttcccgatatccgacggtagtgtaaccatcaattctatatgttg

SEQ ID NO: 1673 - DNA, 70 bp, Artificial Sequence
  Description of Artificial Sequence: Synthetic probe
aaaataacaagccaagtaaacttcagcttcccgatatccgacggtagtgttgtgggtcagaagaaaattt

SEQ ID NO: 1674 - DNA, 70 bp, Artificial Sequence
  Description of Artificial Sequence: Synthetic probe
atttaccatttctccagcacttcagcttcccgatatccgacggtagtgtaaatttaaaattaaaatccaa

SEQ ID NO: 1675 - DNA, 70 bp, Artificial Sequence
  Description of Artificial Sequence: Synthetic probe
catattccaaagcaagagcagccttcagcttcccgatatccgacggtagtgtctgataaggtctgcaagg

SEQ ID NO: 1676 - DNA, 70 bp, Artificial Sequence
  Description of Artificial Sequence: Synthetic probe
ctagctatatcttcacaggacttcagcttcccgatatccgacggtagtgtcagcaagatttgcttctcta

SEQ ID NO: 1677 - DNA, 70 bp, Artificial Sequence
  Description of Artificial Sequence: Synthetic probe
acagactctagctatatcttcacacttcagcttcccgatatccgacggtagtgtacgcagcaagatttgc

SEQ ID NO: 1678 - DNA, 70 bp, Artificial Sequence
  Description of Artificial Sequence: Synthetic probe
tgttaataattaccggatgtgccttcagcttcccgatatccgacggtagtgtttcaaaagttgattgatt

SEQ ID NO: 1679 - DNA, 70 bp, Artificial Sequence
  Description of Artificial Sequence: Synthetic probe
ttaggcaaccatcaattctatcttcagcttcccgatatccgacggtagtgtagaaaaaaatatatataat

SEQ ID NO: 1680 - DNA, 70 bp, Artificial Sequence
  Description of Artificial Sequence: Synthetic probe
aaatatttgtgggtcagaagacttcagcttcccgatatccgacggtagtgttctacaaaagctcccagga

SEQ ID NO: 1681 - DNA, 70 bp, Artificial Sequence
  Description of Artificial Sequence: Synthetic probe
gggaagaaatttaaaattaacttcagcttcccgatatccgacggtagtgtagaatatcctgttcaggaat

SEQ ID NO: 1682 - DNA, 70 bp, Artificial Sequence
  Description of Artificial Sequence: Synthetic probe
taaaagcttctgataaggtctcttcagcttcccgatatccgacggtagtgtgtcctagaaattcttggag

SEQ ID NO: 1683 - DNA, 70 bp, Artificial Sequence
  Description of Artificial Sequence: Synthetic probe
aatgacgcagcaagacttcagcttcccgatatccgacggtagtgtattaaataccttccaaaagtttcat

SEQ ID NO: 1684 - DNA, 70 bp, Artificial Sequence
  Description of Artificial Sequence: Synthetic probe
tcttccattgccacacagacttcagcttcccgatatccgacggtagtgtggccatgagatattcgattga

SEQ ID NO: 1685 - DNA, 70 bp, Artificial Sequence
  Description of Artificial Sequence: Synthetic probe
tcaagcgaggattattagtgtacttcagcttcccgatatccgacggtagtgtggcactgcagaaagtccc

SEQ ID NO: 1686 - DNA, 70 bp, Artificial Sequence
  Description of Artificial Sequence: Synthetic probe
aacagaacaattttgggcaaaccttcagcttcccgatatccgacggtagtgtcggctgatctgcgtaagt

SEQ ID NO: 1687 - DNA, 70 bp, Artificial Sequence
  Description of Artificial Sequence: Synthetic probe
catagaactactgaaggttgcttcagcttcccgatatccgacggtagtgtaaaaaatgttttacttaagt

SEQ ID NO: 1688 - DNA, 70 bp, Artificial Sequence
  Description of Artificial Sequence: Synthetic probe
tattatgtaagatatgaattcacttcagcttcccgatatccgacggtagtgtggaactgtcagctaatgt

SEQ ID NO: 1689 - DNA, 70 bp, Artificial Sequence
  Description of Artificial Sequence: Synthetic probe
cctctctagaaaaagaaaatgcttcagcttcccgatatccgacggtagtgtcacttgcttttacattgaa

SEQ ID NO: 1690 - DNA, 70 bp, Artificial Sequence
  Description of Artificial Sequence: Synthetic probe
gccatgagatattcgattgcttcagcttcccgatatccgacggtagtgtacacttaacataagttattcc

SEQ ID NO: 1691 - DNA, 70 bp, Artificial Sequence
  Description of Artificial Sequence: Synthetic probe
gaggcactgcagaaagtcccttcagcttcccgatatccgacggtagtgtaatacatgaacaaatgaacta

SEQ ID NO: 1692 - DNA, 70 bp, Artificial Sequence
  Description of Artificial Sequence: Synthetic probe
ttctacatagtttctgcactcttcagcttcccgatatccgacggtagtgtccagaacctataactgttac

SEQ ID NO: 1693 - DNA, 70 bp, Artificial Sequence
  Description of Artificial Sequence: Synthetic probe
acctcttacagtacaaatcagcacttcagcttcccgatatccgacggtagtgtagcagcaacatatcctc

SEQ ID NO: 1694 - DNA, 70 bp, Artificial Sequence
  Description of Artificial Sequence: Synthetic probe
agcaaacaaataacccttcagcttcccgatatccgacggtagtgtccttaccttgaagcctaactgggca

SEQ ID NO: 1695 - DNA, 70 bp, Artificial Sequence
  Description of Artificial Sequence: Synthetic probe
tttaccaaaaagagctctttggcttcagcttcccgatatccgacggtagtgtacttagtttgagttcaaa

SEQ ID NO: 1696 - DNA, 70 bp, Artificial Sequence
  Description of Artificial Sequence: Synthetic probe
atataaaatagtaaattgctcttcagcttcccgatatccgacggtagtgtacccttcccaaattaaaata

SEQ ID NO: 1697 - DNA, 70 bp, Artificial Sequence
  Description of Artificial Sequence: Synthetic probe
catcaactacgataaaagccttcagcttcccgatatccgacggtagtgttgcaaagtactttataaatat

SEQ ID NO: 1698 - DNA, 70 bp, Artificial Sequence
  Description of Artificial Sequence: Synthetic probe
ccagaacctataactgttaccttcagcttcccgatatccgacggtagtgtggaagtatttaccatgtttt

SEQ ID NO: 1699 - DNA, 70 bp, Artificial Sequence
  Description of Artificial Sequence: Synthetic probe
aatagcagcaacatatcctcttcagcttcccgatatccgacggtagtgtggcttacaagtaatttataga

SEQ ID NO: 1700 - DNA, 70 bp, Artificial Sequence
  Description of Artificial Sequence: Synthetic probe
atagtcctttataatttatcacttcagcttcccgatatccgacggtagtgttttttctcaatgcagactg

SEQ ID NO: 1701 - DNA, 70 bp, Artificial Sequence
  Description of Artificial Sequence: Synthetic probe
gctatgttttcacagactaaacttcagcttcccgatatccgacggtagtgtcaagcatgttccaccaagt

SEQ ID NO: 1702 - DNA, 70 bp, Artificial Sequence
  Description of Artificial Sequence: Synthetic probe
ttcttctacaaaacaagctcttcagcttcccgatatccgacggtagtgtcaccttagaaggaatacaacc

SEQ ID NO: 1703 - DNA, 70 bp, Artificial Sequence
  Description of Artificial Sequence: Synthetic probe
ctaaaattccaaatatatgtctcttcagcttcccgatatccgacggtagtgttgtgctgtacaaaacaca

SEQ ID NO: 1704 - DNA, 70 bp, Artificial Sequence
  Description of Artificial Sequence: Synthetic probe
cacataacctcaatgtttcacttcagcttcccgatatccgacggtagtgtagttggttgctagccaaaaa

SEQ ID NO: 1705 - DNA, 70 bp, Artificial Sequence
  Description of Artificial Sequence: Synthetic probe
aaccaaagaaaacattatttaaccttcagcttcccgatatccgacggtagtgttctagtctcaatccatc

SEQ ID NO: 1706 - DNA, 70 bp, Artificial Sequence
  Description of Artificial Sequence: Synthetic probe
atttttctcaatgcagactgtcttcagcttcccgatatccgacggtagtgttgttttttaacaagtgtat

SEQ ID NO: 1707 - DNA, 70 bp, Artificial Sequence
  Description of Artificial Sequence: Synthetic probe
tcaagcatgttccaccaagtcttcagcttcccgatatccgacggtagtgttgtgtgaaatgtgccacaac

SEQ ID NO: 1708 - DNA, 70 bp, Artificial Sequence
  Description of Artificial Sequence: Synthetic probe
gctggagtgcaatggcgccttcagcttcccgatatccgacggtagtgtaataatgagagttgttcaataa

SEQ ID NO: 1709 - DNA, 70 bp, Artificial Sequence
  Description of Artificial Sequence: Synthetic probe
acggagtttcgttcttattgcccaacttcagcttcccgatatccgacggtagtgtttccatgggccatat

SEQ ID NO: 1710 - DNA, 70 bp, Artificial Sequence
  Description of Artificial Sequence: Synthetic probe
atagtctttcttttcatttttcttcagcttcccgatatccgacggtagtgtactttcaattcctctagat

SEQ ID NO: 1711 - DNA, 70 bp, Artificial Sequence
  Description of Artificial Sequence: Synthetic probe
ataatcaaaaagcacttatgaacttcagcttcccgatatccgacggtagtgttcattaagcatgaaaagt

SEQ ID NO: 1712 - DNA, 70 bp, Artificial Sequence
  Description of Artificial Sequence: Synthetic probe
tcaaatattcataaacagacttccttcagcttcccgatatccgacggtagtgtgccaagtcaagcagtct

SEQ ID NO: 1713 - DNA, 70 bp, Artificial Sequence
  Description of Artificial Sequence: Synthetic probe
aaaggaaattaaaaagatcacttcagcttcccgatatccgacggtagtgtagacacatttaagtctttag

SEQ ID NO: 1714 - DNA, 70 bp, Artificial Sequence
  Description of Artificial Sequence: Synthetic probe
taatgagagttgttcaataaagccttcagcttcccgatatccgacggtagtgtaaacatctattatgcgt

SEQ ID NO: 1715 - DNA, 70 bp, Artificial Sequence
  Description of Artificial Sequence: Synthetic probe
atcttttccatgggccacttcagcttcccgatatccgacggtagtgttttagattatttattttactctt

SEQ ID NO: 1716 - DNA, 70 bp, Artificial Sequence
  Description of Artificial Sequence: Synthetic probe
ttcaaaatgtaataacttataacttcagcttcccgatatccgacggtagtgttcttgtctaaattcaagc

SEQ ID NO: 1717 - DNA, 70 bp, Artificial Sequence
  Description of Artificial Sequence: Synthetic probe
tgcttataaaaggcagtattaacttcagcttcccgatatccgacggtagtgtactgcagtactcttctgc

SEQ ID NO: 1718 - DNA, 70 bp, Artificial Sequence
  Description of Artificial Sequence: Synthetic probe
caccaactggaaaatttcaacccttcagcttcccgatatccgacggtagtgtggcaattccacctgttaa

SEQ ID NO: 1719 - DNA, 70 bp, Artificial Sequence
  Description of Artificial Sequence: Synthetic probe
gaagcaatatgcagtgtttcttcagcttcccgatatccgacggtagtgtcactgaccttattctgtttga

SEQ ID NO: 1720 - DNA, 70 bp, Artificial Sequence
  Description of Artificial Sequence: Synthetic probe
atctttagttcttagctaacttcagcttcccgatatccgacggtagtgtgtaaagcagaaatctgaatat

SEQ ID NO: 1721 - DNA, 70 bp, Artificial Sequence
  Description of Artificial Sequence: Synthetic probe
tcggacactgtaatttgttccttcagcttcccgatatccgacggtagtgttgcaaagtttaatttgtatt

SEQ ID NO: 1722 - DNA, 70 bp, Artificial Sequence
  Description of Artificial Sequence: Synthetic probe
catcttgtctaaattcaagccttcagcttcccgatatccgacggtagtgtaagttcaaatatcatcactc

SEQ ID NO: 1723 - DNA, 70 bp, Artificial Sequence
  Description of Artificial Sequence: Synthetic probe
ttactgcagtactcttctgctcttcagcttcccgatatccgacggtagtgtttaaataaatattcccctg

SEQ ID NO: 1724 - DNA, 70 bp, Artificial Sequence
  Description of Artificial Sequence: Synthetic probe
tgggcaattccacctgtcttcagcttcccgatatccgacggtagtgttctatttcaggttagcaagctat

SEQ ID NO: 1725 - DNA, 70 bp, Artificial Sequence
  Description of Artificial Sequence: Synthetic probe
caccatggtgcagcaaacttcagcttcccgatatccgacggtagtgttctttccatatccattgacatga

SEQ ID NO: 1726 - DNA, 70 bp, Artificial Sequence
  Description of Artificial Sequence: Synthetic probe
aatgcttccttacttagtaacttcagcttcccgatatccgacggtagtgtgtgacttgatttttgccagt

SEQ ID NO: 1727 - DNA, 70 bp, Artificial Sequence
  Description of Artificial Sequence: Synthetic probe
gtaacttctgaacccgtggccttcagcttcccgatatccgacggtagtgtaaagctgaatgaccatcaaa

SEQ ID NO: 1728 - DNA, 70 bp, Artificial Sequence
  Description of Artificial Sequence: Synthetic probe
tctgtaaataatttatctaaaacacttcagcttcccgatatccgacggtagtgtccgccatcagctttcg

SEQ ID NO: 1729 - DNA, 70 bp, Artificial Sequence
  Description of Artificial Sequence: Synthetic probe
ataaatcattcaaaggaaacttcagcttcccgatatccgacggtagtgtagaatgttctttgtatcaata

SEQ ID NO: 1730 - DNA, 70 bp, Artificial Sequence
  Description of Artificial Sequence: Synthetic probe
cacaaagtttaaagtaatttgtttgcttcagcttcccgatatccgacggtagtgtttctgaacccgtggc

SEQ ID NO: 1731 - DNA, 70 bp, Artificial Sequence
  Description of Artificial Sequence: Synthetic probe
ctttacaaaataatctttataaacttcagcttcccgatatccgacggtagtgttaccgtgattccaggaa

SEQ ID NO: 1732 - DNA, 70 bp, Artificial Sequence
  Description of Artificial Sequence: Synthetic probe
ttccatatccattgacatgcttcagcttcccgatatccgacggtagtgttgtaatggttgtaaattatga

SEQ ID NO: 1733 - DNA, 70 bp, Artificial Sequence
  Description of Artificial Sequence: Synthetic probe
gtgacttgatttttgccagtcttcagcttcccgatatccgacggtagtgttaaaacgtatttctaaagaa

SEQ ID NO: 1734 - DNA, 70 bp, Artificial Sequence
  Description of Artificial Sequence: Synthetic probe
agtgccgccatcagctcttcagcttcccgatatccgacggtagtgtcaaagttcacaaatagcataaata

SEQ ID NO: 1735 - DNA, 70 bp, Artificial Sequence
  Description of Artificial Sequence: Synthetic probe
gaatgttctttgtatcaataacccttcagcttcccgatatccgacggtagtgttttcagtcagaaatctc

SEQ ID NO: 1736 - DNA, 70 bp, Artificial Sequence
  Description of Artificial Sequence: Synthetic probe
gatggttgcatctgtactgcttcagcttcccgatatccgacggtagtgtacactattgtatcttcatcta

SEQ ID NO: 1737 - DNA, 70 bp, Artificial Sequence
  Description of Artificial Sequence: Synthetic probe
attgaaaatattcaggaaaaaaacttcagcttcccgatatccgacggtagtgtaagataaagcacctgta

SEQ ID NO: 1738 - DNA, 70 bp, Artificial Sequence
  Description of Artificial Sequence: Synthetic probe
aatttgcagatttaaccaacccttcagcttcccgatatccgacggtagtgtcaaccatcttttctggaac

SEQ ID NO: 1739 - DNA, 70 bp, Artificial Sequence
  Description of Artificial Sequence: Synthetic probe
cgaccctccatatccatgggttcccttcagcttcccgatatccgacggtagtgtcctattactcctgcac

SEQ ID NO: 1740 - DNA, 70 bp, Artificial Sequence
  Description of Artificial Sequence: Synthetic probe
ataatttgaaaaaacctagtacacttcagcttcccgatatccgacggtagtgtgaaagacaacacttacc

SEQ ID NO: 1741 - DNA, 70 bp, Artificial Sequence
  Description of Artificial Sequence: Synthetic probe
aagaaaaacaaaagatataatcacttcagcttcccgatatccgacggtagtgtaactccaaggaggtaat

SEQ ID NO: 1742 - DNA, 70 bp, Artificial Sequence
  Description of Artificial Sequence: Synthetic probe
cactattgtatcttcatctatctgcttcagcttcccgatatccgacggtagtgtaaaggggacctttaag

SEQ ID NO: 1743 - DNA, 70 bp, Artificial Sequence
  Description of Artificial Sequence: Synthetic probe
ttaaagataaagcacctgtagcttcagcttcccgatatccgacggtagtgtcagcctgtaatgttataca

SEQ ID NO: 1744 - DNA, 70 bp, Artificial Sequence
  Description of Artificial Sequence: Synthetic probe
acaaccatcttttctggaaccttcagcttcccgatatccgacggtagtgtgtgtttaagcaaaactcaat

SEQ ID NO: 1745 - DNA, 70 bp, Artificial Sequence
  Description of Artificial Sequence: Synthetic probe
tacacctattactcctgccttcagcttcccgatatccgacggtagtgtacaaaagtaaactctttattac

SEQ ID NO: 1746 - DNA, 70 bp, Artificial Sequence
  Description of Artificial Sequence: Synthetic probe
gagaagctccgaggtttaaacttcagcttcccgatatccgacggtagtgtgtcacatctgcaccaagtct

SEQ ID NO: 1747 - DNA, 70 bp, Artificial Sequence
  Description of Artificial Sequence: Synthetic probe
tcttctttcgctagtatgtcttcagcttcccgatatccgacggtagtgtctacatgacctaaaaattcaa

SEQ ID NO: 1748 - DNA, 70 bp, Artificial Sequence
  Description of Artificial Sequence: Synthetic probe
tttaaatttaaacccctgttcttcagcttcccgatatccgacggtagtgtaaaaaccctatatttgctaa

SEQ ID NO: 1749 - DNA, 70 bp, Artificial Sequence
  Description of Artificial Sequence: Synthetic probe
tagcaccagtaacctttgtcttcagcttcccgatatccgacggtagtgtaagtaataaaatgaccttaag

SEQ ID NO: 1750 - DNA, 70 bp, Artificial Sequence
  Description of Artificial Sequence: Synthetic probe
tcaatttttccatctgacttctcttcagcttcccgatatccgacggtagtgttgataagcaactgagtta

SEQ ID NO: 1751 - DNA, 70 bp, Artificial Sequence
  Description of Artificial Sequence: Synthetic probe
cttaataatttattgtaaaacacttcagcttcccgatatccgacggtagtgttccatatcaattccaact

SEQ ID NO: 1752 - DNA, 70 bp, Artificial Sequence
  Description of Artificial Sequence: Synthetic probe
ctatagcaaatgtttacgaacttcagcttcccgatatccgacggtagtgtaggatgcgttgaaagttttt

SEQ ID NO: 1753 - DNA, 70 bp, Artificial Sequence
  Description of Artificial Sequence: Synthetic probe
aaaaacccaataatcataaaagtcttcagcttcccgatatccgacggtagtgtaaatttaaacccctgtt

SEQ ID NO: 1754 - DNA, 70 bp, Artificial Sequence
  Description of Artificial Sequence: Synthetic probe
aaactgaaccctgcaaataaacttcagcttcccgatatccgacggtagtgtagcaccagtaacctttgta

SEQ ID NO: 1755 - DNA, 70 bp, Artificial Sequence
  Description of Artificial Sequence: Synthetic probe
gtcacatctgcaccaagtctcttcagcttcccgatatccgacggtagtgttcaatttttccatctgactt

SEQ ID NO: 1756 - DNA, 70 bp, Artificial Sequence
  Description of Artificial Sequence: Synthetic probe
tacatgacctaaaaattcaacttcagcttcccgatatccgacggtagtgtacaaatgatgtatacttacg

SEQ ID NO: 1757 - DNA, 70 bp, Artificial Sequence
  Description of Artificial Sequence: Synthetic probe
tctccatatcaattccaactcccttcagcttcccgatatccgacggtagtgtgagacagggatgatacat

SEQ ID NO: 1758 - DNA, 70 bp, Artificial Sequence
  Description of Artificial Sequence: Synthetic probe
aggatgcgttgaaagttcttcagcttcccgatatccgacggtagtgttgattttgaaacttgagtgtttt

SEQ ID NO: 1759 - DNA, 70 bp, Artificial Sequence
  Description of Artificial Sequence: Synthetic probe
tacatcttccttaggaactcccttcagcttcccgatatccgacggtagtgttgtcttcctaatccatcgg

SEQ ID NO: 1760 - DNA, 70 bp, Artificial Sequence
  Description of Artificial Sequence: Synthetic probe
actgagccacgtgaagacacttcagcttcccgatatccgacggtagtgttcagtcaataccacaagtccc

SEQ ID NO: 1761 - DNA, 70 bp, Artificial Sequence
  Description of Artificial Sequence: Synthetic probe
atttctaaaaggctcttcttcagcttcccgatatccgacggtagtgtgcatccaaaactgataatcacaa

SEQ ID NO: 1762 - DNA, 70 bp, Artificial Sequence
  Description of Artificial Sequence: Synthetic probe
ttgctgggtttccaaagtgcttcagcttcccgatatccgacggtagtgtctgggtggcattctgtcttgg

SEQ ID NO: 1763 - DNA, 70 bp, Artificial Sequence
  Description of Artificial Sequence: Synthetic probe
tgatcccatacagaaagcttcttcagcttcccgatatccgacggtagtgttctggtagagtccctgaagt

SEQ ID NO: 1764 - DNA, 70 bp, Artificial Sequence
  Description of Artificial Sequence: Synthetic probe
tccaaaactgataatcacacttcagcttcccgatatccgacggtagtgtaaataatttcattattctggt

SEQ ID NO: 1765 - DNA, 70 bp, Artificial Sequence
  Description of Artificial Sequence: Synthetic probe
atctactgaatcttgagccacttcagcttcccgatatccgacggtagtgtacttaccatctctttcaagg

SEQ ID NO: 1766 - DNA, 70 bp, Artificial Sequence
  Description of Artificial Sequence: Synthetic probe
gaaaaagcgaaaaggtgacttcagcttcccgatatccgacggtagtgtcatacatcttccttaggaactc

SEQ ID NO: 1767 - DNA, 70 bp, Artificial Sequence
  Description of Artificial Sequence: Synthetic probe
tcacagcagcctgtccacttcagcttcccgatatccgacggtagtgtggaactgagccacgtgaagacag

SEQ ID NO: 1768 - DNA, 70 bp, Artificial Sequence
  Description of Artificial Sequence: Synthetic probe
ggaaatggtcggcacacacttcagcttcccgatatccgacggtagtgttcttgctgggtttccaaagtgg

SEQ ID NO: 1769 - DNA, 70 bp, Artificial Sequence
  Description of Artificial Sequence: Synthetic probe
tgtaagaaagggaacaaacttcagcttcccgatatccgacggtagtgtcctgatcccatacagaaagctt

SEQ ID NO: 1770 - DNA, 70 bp, Artificial Sequence
  Description of Artificial Sequence: Synthetic probe
agcagcaccatggcaagagatggagcttcagcttcccgatatccgacggtagtgttaaagggatcttaga

SEQ ID NO: 1771 - DNA, 70 bp, Artificial Sequence
  Description of Artificial Sequence: Synthetic probe
aagtgtaaggaaagtaggtccttcagcttcccgatatccgacggtagtgtccagttctgtctccctcatg

SEQ ID NO: 1772 - DNA, 70 bp, Artificial Sequence
  Description of Artificial Sequence: Synthetic probe
tgcaaaccgcagctgccttcagcttcccgatatccgacggtagtgttgtagataagggcctgatgaggag

SEQ ID NO: 1773 - DNA, 70 bp, Artificial Sequence
  Description of Artificial Sequence: Synthetic probe
gaaaatccaaagagcatgaacacttcagcttcccgatatccgacggtagtgttttgacaatgctcttccc

SEQ ID NO: 1774 - DNA, 70 bp, Artificial Sequence
  Description of Artificial Sequence: Synthetic probe
agattgaaacggggtcaggcttcagcttcccgatatccgacggtagtgtaatcattctgatgtgggcaaa

SEQ ID NO: 1775 - DNA, 70 bp, Artificial Sequence
  Description of Artificial Sequence: Synthetic probe
caaaactctgagtcctctgccttcagcttcccgatatccgacggtagtgtccctaactcaccttgagggt

SEQ ID NO: 1776 - DNA, 70 bp, Artificial Sequence
  Description of Artificial Sequence: Synthetic probe
aaagacccaccagtactaacacttcagcttcccgatatccgacggtagtgtgcagcaccatggcaagaga

SEQ ID NO: 1777 - DNA, 70 bp, Artificial Sequence
  Description of Artificial Sequence: Synthetic probe
cagaacactttcttaaacacttcagcttcccgatatccgacggtagtgtgaagtgtaaggaaagtaggtc

SEQ ID NO: 1778 - DNA, 70 bp, Artificial Sequence
  Description of Artificial Sequence: Synthetic probe
atgagtctggtcttcaactgcttcagcttcccgatatccgacggtagtgtccacttctcacttcaccatg

SEQ ID NO: 1779 - DNA, 70 bp, Artificial Sequence
  Description of Artificial Sequence: Synthetic probe
ctgagcagttcagaaatatgcttcacttcagcttcccgatatccgacggtagtgtgtttggtgatggtcc

SEQ ID NO: 1780 - DNA, 70 bp, Artificial Sequence
  Description of Artificial Sequence: Synthetic probe
gtgtctggagccagtgtccttcagcttcccgatatccgacggtagtgtaccagtaatgccttcctctgtc

SEQ ID NO: 1781 - DNA, 70 bp, Artificial Sequence
  Description of Artificial Sequence: Synthetic probe
gatatctgcgggtggagagacttcagcttcccgatatccgacggtagtgttgctcaaagggcagatgagg

SEQ ID NO: 1782 - DNA, 70 bp, Artificial Sequence
  Description of Artificial Sequence: Synthetic probe
gtcagagggcaactgaggacttcagcttcccgatatccgacggtagtgtagggaaaccatgtgtgaagta

SEQ ID NO: 1783 - DNA, 70 bp, Artificial Sequence
  Description of Artificial Sequence: Synthetic probe
aagcccatgaggaaccacccttcagcttcccgatatccgacggtagtgttgggagtggtcagtgtttgct

SEQ ID NO: 1784 - DNA, 70 bp, Artificial Sequence
  Description of Artificial Sequence: Synthetic probe
gatgacctgaagagtctttggcttcagcttcccgatatccgacggtagtgttgagtctggtcttcaactg

SEQ ID NO: 1785 - DNA, 70 bp, Artificial Sequence
  Description of Artificial Sequence: Synthetic probe
cgccctttacttctggtcttcagcttcccgatatccgacggtagtgttctctgagcagttcagaaatatg

SEQ ID NO: 1786 - DNA, 70 bp, Artificial Sequence
  Description of Artificial Sequence: Synthetic probe
cccaatactgttctcatgcttcttcagcttcccgatatccgacggtagtgttgtctggagccagtgtccc

SEQ ID NO: 1787 - DNA, 70 bp, Artificial Sequence
  Description of Artificial Sequence: Synthetic probe
agtctgtgctctctgctgcccttcagcttcccgatatccgacggtagtgtatgcctgcaggttgccatga

SEQ ID NO: 1788 - DNA, 70 bp, Artificial Sequence
  Description of Artificial Sequence: Synthetic probe
tcacgggggccgtagtagacttcagcttcccgatatccgacggtagtgttgccatctgtgggcagagctc

SEQ ID NO: 1789 - DNA, 70 bp, Artificial Sequence
  Description of Artificial Sequence: Synthetic probe
tgccaacggttggcttaaatcttcagcttcccgatatccgacggtagtgttctgccaccatctcagccca

SEQ ID NO: 1790 - DNA, 70 bp, Artificial Sequence
  Description of Artificial Sequence: Synthetic probe
ttatccactgaagtgcaacccttcagcttcccgatatccgacggtagtgtcgaagtgaatgaacaggaac

SEQ ID NO: 1791 - DNA, 70 bp, Artificial Sequence
  Description of Artificial Sequence: Synthetic probe
ggaatacaatttagattcagaacttcagcttcccgatatccgacggtagtgtcaaagggacctccgcagg

SEQ ID NO: 1792 - DNA, 70 bp, Artificial Sequence
  Description of Artificial Sequence: Synthetic probe
agagccacagcagggcccttcagcttcccgatatccgacggtagtgtgtgtcatggaagccaagcccaca

SEQ ID NO: 1793 - DNA, 70 bp, Artificial Sequence
  Description of Artificial Sequence: Synthetic probe
ttcggctgccgacatcagtcttcagcttcccgatatccgacggtagtgtagcccctctctgcaagctcct

SEQ ID NO: 1794 - DNA, 70 bp, Artificial Sequence
  Description of Artificial Sequence: Synthetic probe
tctgccaccatctcagcccatcttcagcttcccgatatccgacggtagtgtcccccagagcccaccccaa

SEQ ID NO: 1795 - DNA, 70 bp, Artificial Sequence
  Description of Artificial Sequence: Synthetic probe
cgaagtgaatgaacaggaaccacttcagcttcccgatatccgacggtagtgtcagtggggcctgctaccc

SEQ ID NO: 1796 - DNA, 70 bp, Artificial Sequence
  Description of Artificial Sequence: Synthetic probe
ctcaaagggacctccgcaggcttcagcttcccgatatccgacggtagtgtagtctgtgctctctgctgcc

SEQ ID NO: 1797 - DNA, 70 bp, Artificial Sequence
  Description of Artificial Sequence: Synthetic probe
gaacagaggcagaacacatggcttcagcttcccgatatccgacggtagtgtcacgggggccgtagtagaa

SEQ ID NO: 1798 - DNA, 70 bp, Artificial Sequence
  Description of Artificial Sequence: Synthetic probe
tgacaacctaaattcttcttcctcttcagcttcccgatatccgacggtagtgtgccacagcagggccgtg

SEQ ID NO: 1799 - DNA, 70 bp, Artificial Sequence
  Description of Artificial Sequence: Synthetic probe
gggtttttaaagcaactttaaccttcagcttcccgatatccgacggtagtgtcggctgccgacatcagta

SEQ ID NO: 1800 - DNA, 70 bp, Artificial Sequence
  Description of Artificial Sequence: Synthetic probe
cccaggcgatcgtgtgcttcagcttcccgatatccgacggtagtgttcaacctccttgaccatttatctg

SEQ ID NO: 1801 - DNA, 70 bp, Artificial Sequence
  Description of Artificial Sequence: Synthetic probe
agcccagagcaggaagttgcttcagcttcccgatatccgacggtagtgtgggcagcatcctggtacacac

SEQ ID NO: 1802 - DNA, 70 bp, Artificial Sequence
  Description of Artificial Sequence: Synthetic probe
gatttatttatttgctttgaaacacttcagcttcccgatatccgacggtagtgtcctgctaccgtctgca

SEQ ID NO: 1803 - DNA, 70 bp, Artificial Sequence
  Description of Artificial Sequence: Synthetic probe
cccccagaaacgggtaagcaccttcagcttcccgatatccgacggtagtgtgggctgagaggctgctgct

SEQ ID NO: 1804 - DNA, 70 bp, Artificial Sequence
  Description of Artificial Sequence: Synthetic probe
ccctgagagagggagctaggcttcagcttcccgatatccgacggtagtgtacattgccaggaggtggccc

SEQ ID NO: 1805 - DNA, 70 bp, Artificial Sequence
  Description of Artificial Sequence: Synthetic probe
aggtgcctgatcagctgttgtcttcagcttcccgatatccgacggtagtgtcagaggccagaccctcgga

SEQ ID NO: 1806 - DNA, 70 bp, Artificial Sequence
  Description of Artificial Sequence: Synthetic probe
gagctctgaggtctgtgtctgcttcagcttcccgatatccgacggtagtgtacccacctctcgcctggag

SEQ ID NO: 1807 - DNA, 70 bp, Artificial Sequence
  Description of Artificial Sequence: Synthetic probe
ctgtcctgctaccgtctgccttcagcttcccgatatccgacggtagtgtaatgagtactaggatgctgga

SEQ ID NO: 1808 - DNA, 70 bp, Artificial Sequence
  Description of Artificial Sequence: Synthetic probe
tgggctgagaggctgctcttcagcttcccgatatccgacggtagtgtacagggagacttaccagggtgat

SEQ ID NO: 1809 - DNA, 70 bp, Artificial Sequence
  Description of Artificial Sequence: Synthetic probe
acattgccaggaggtggcccttcagcttcccgatatccgacggtagtgttcccaggcgatcgtgtggcct

SEQ ID NO: 1810 - DNA, 70 bp, Artificial Sequence
  Description of Artificial Sequence: Synthetic probe
ggccttcacctggacctcttcagcttcccgatatccgacggtagtgtaggagcccagagcaggaagttga

SEQ ID NO: 1811 - DNA, 70 bp, Artificial Sequence
  Description of Artificial Sequence: Synthetic probe
gtatttcacaggggagaggtcttcagcttcccgatatccgacggtagtgtaggtgcctgatcagctgttg

SEQ ID NO: 1812 - DNA, 70 bp, Artificial Sequence
  Description of Artificial Sequence: Synthetic probe
agaggcaggacagacataccttcagcttcccgatatccgacggtagtgtggagctctgaggtctgtgtct

SEQ ID NO: 1813 - DNA, 70 bp, Artificial Sequence
  Description of Artificial Sequence: Synthetic probe
gagttcgcagctctttaaggcttcagcttcccgatatccgacggtagtgttgtcccaagatgtgtacagc

SEQ ID NO: 1814 - DNA, 70 bp, Artificial Sequence
  Description of Artificial Sequence: Synthetic probe
tcgggccagtttttctgatctagcttcagcttcccgatatccgacggtagtgtacagcccagcgagggca

SEQ ID NO: 1815 - DNA, 70 bp, Artificial Sequence
  Description of Artificial Sequence: Synthetic probe
ccatcagttccaaagtcttcagcttcccgatatccgacggtagtgtagccaatgatctcgtgagttatct

SEQ ID NO: 1816 - DNA, 70 bp, Artificial Sequence
  Description of Artificial Sequence: Synthetic probe
ctttcaatgccaagacgattcccttcagcttcccgatatccgacggtagtgtcacaaatgcgtggccaca

SEQ ID NO: 1817 - DNA, 70 bp, Artificial Sequence
  Description of Artificial Sequence: Synthetic probe
tgtacaaggtctggtcaagaaacttcagcttcccgatatccgacggtagtgtacctgtcctgtggccctg

SEQ ID NO: 1818 - DNA, 70 bp, Artificial Sequence
  Description of Artificial Sequence: Synthetic probe
aatgatctcgtgagttatctcagcacttcagcttcccgatatccgacggtagtgttccctcacgccgggc

SEQ ID NO: 1819 - DNA, 70 bp, Artificial Sequence
  Description of Artificial Sequence: Synthetic probe
gtgtgagccatctgcaatcaggcttcagcttcccgatatccgacggtagtgtcggcctgcgtgccttcta

SEQ ID NO: 1820 - DNA, 70 bp, Artificial Sequence
  Description of Artificial Sequence: Synthetic probe
gaagagaaggcaaattaaaacacttcagcttcccgatatccgacggtagtgtgttcgcagctctttaagg

SEQ ID NO: 1821 - DNA, 70 bp, Artificial Sequence
  Description of Artificial Sequence: Synthetic probe
tccagacagatttgtcctttcttcagcttcccgatatccgacggtagtgttcgggccagtttttctgatc

SEQ ID NO: 1822 - DNA, 70 bp, Artificial Sequence
  Description of Artificial Sequence: Synthetic probe
gggacggaccataaccaccttcagcttcccgatatccgacggtagtgtggctttcaatgccaagacgatt

SEQ ID NO: 1823 - DNA, 70 bp, Artificial Sequence
  Description of Artificial Sequence: Synthetic probe
ctgaaagaagccctatccagcttcagcttcccgatatccgacggtagtgttgtacaaggtctggtcaaga

SEQ ID NO: 1824 - DNA, 70 bp, Artificial Sequence
  Description of Artificial Sequence: Synthetic probe
taaaaggattccaacaagccttcagcttcccgatatccgacggtagtgtgtaatagaacaatgaatacat

SEQ ID NO: 1825 - DNA, 70 bp, Artificial Sequence
  Description of Artificial Sequence: Synthetic probe
caacagttgaccaattgtggcttcagcttcccgatatccgacggtagtgtaagttgttccattaaaaaaa

SEQ ID NO: 1826 - DNA, 70 bp, Artificial Sequence
  Description of Artificial Sequence: Synthetic probe
ctttcaatgactgtattagcttcagcttcccgatatccgacggtagtgtactaggagaaaggttcataat

SEQ ID NO: 1827 - DNA, 70 bp, Artificial Sequence
  Description of Artificial Sequence: Synthetic probe
gtgaaagaaaaataaattttggcttcagcttcccgatatccgacggtagtgttctgtgaaacaatgcaaa

SEQ ID NO: 1828 - DNA, 70 bp, Artificial Sequence
  Description of Artificial Sequence: Synthetic probe
gtaaaggcattatgcaactcttcagcttcccgatatccgacggtagtgtaaaatagccattttgagagga

SEQ ID NO: 1829 - DNA, 70 bp, Artificial Sequence
  Description of Artificial Sequence: Synthetic probe
tactgaactgacattatcttcagcttcccgatatccgacggtagtgtcgtttttgattcttaccatatgc

SEQ ID NO: 1830 - DNA, 70 bp, Artificial Sequence
  Description of Artificial Sequence: Synthetic probe
ggaacgtgaatgcttcttgttcttcagcttcccgatatccgacggtagtgtaaaaggattccaacaagct

SEQ ID NO: 1831 - DNA, 70 bp, Artificial Sequence
  Description of Artificial Sequence: Synthetic probe
ataccatttttaaaagtaagcacttcagcttcccgatatccgacggtagtgtacagttgaccaattgtgg

SEQ ID NO: 1832 - DNA, 70 bp, Artificial Sequence
  Description of Artificial Sequence: Synthetic probe
aaggattagagaagatcttcttcagcttcccgatatccgacggtagtgttctttcaatgactgtattaga

SEQ ID NO: 1833 - DNA, 70 bp, Artificial Sequence
  Description of Artificial Sequence: Synthetic probe
tgtatccaggagttaagttttgacttcagcttcccgatatccgacggtagtgtgataatgtaacagtgaa

SEQ ID NO: 1834 - DNA, 70 bp, Artificial Sequence
  Description of Artificial Sequence: Synthetic probe
gtccagaattctgtggcttcagcttcccgatatccgacggtagtgtggtatgtttgaaaaagtttctaaa

SEQ ID NO: 1835 - DNA, 70 bp, Artificial Sequence
  Description of Artificial Sequence: Synthetic probe
aattagacaacataagcaccatcttcagcttcccgatatccgacggtagtgtagaactggattccacccc

SEQ ID NO: 1836 - DNA, 70 bp, Artificial Sequence
  Description of Artificial Sequence: Synthetic probe
agaattttttggctttcacttcagcttcccgatatccgacggtagtgtccaaaatttttttaagcagcac

SEQ ID NO: 1837 - DNA, 70 bp, Artificial Sequence
  Description of Artificial Sequence: Synthetic probe
aaaggaaaacttaataagtcttcagcttcccgatatccgacggtagtgtaaataatcaatttaattcaaa

SEQ ID NO: 1838 - DNA, 70 bp, Artificial Sequence
  Description of Artificial Sequence: Synthetic probe
aagcagaaaaaatcattaacttcagcttcccgatatccgacggtagtgttgcagagcaagatttactctc

SEQ ID NO: 1839 - DNA, 70 bp, Artificial Sequence
  Description of Artificial Sequence: Synthetic probe
aacactgtaaacattatcttcagcttcccgatatccgacggtagtgtacctgtatccaggagttaagttt

SEQ ID NO: 1840 - DNA, 70 bp, Artificial Sequence
  Description of Artificial Sequence: Synthetic probe
aaatctcaaactactaagttcacttcagcttcccgatatccgacggtagtgtccagaattctgtggttct

SEQ ID NO: 1841 - DNA, 70 bp, Artificial Sequence
  Description of Artificial Sequence: Synthetic probe
aacaagtatccctgaatataaccttcagcttcccgatatccgacggtagtgtttagacaacataagcacc

SEQ ID NO: 1842 - DNA, 70 bp, Artificial Sequence
  Description of Artificial Sequence: Synthetic probe
tagtaatctataggtgcacttcagcttcccgatatccgacggtagtgtccaaggtaagaagagataaaca

SEQ ID NO: 1843 - DNA, 70 bp, Artificial Sequence
  Description of Artificial Sequence: Synthetic probe
gaccttgagtgaaaagagcacttcagcttcccgatatccgacggtagtgtaagttaaacatctcttctgg

SEQ ID NO: 1844 - DNA, 70 bp, Artificial Sequence
  Description of Artificial Sequence: Synthetic probe
tttatcaaatctgagtgccttcagcttcccgatatccgacggtagtgtactgaaatatttccatttactc

SEQ ID NO: 1845 - DNA, 70 bp, Artificial Sequence
  Description of Artificial Sequence: Synthetic probe
atatgagataatacaccctcttcagcttcccgatatccgacggtagtgttgctgatggcacattcagcat

SEQ ID NO: 1846 - DNA, 70 bp, Artificial Sequence
  Description of Artificial Sequence: Synthetic probe
cataaacagaaaaagttcttcagcttcccgatatccgacggtagtgtaacatttcaaaagtgataaattt

SEQ ID NO: 1847 - DNA, 70 bp, Artificial Sequence
  Description of Artificial Sequence: Synthetic probe
taaaagtaaatgcaagtgcccttcagcttcccgatatccgacggtagtgtactcacatttttaagcaaac

SEQ ID NO: 1848 - DNA, 70 bp, Artificial Sequence
  Description of Artificial Sequence: Synthetic probe
tgtacaatgcctacaacttcagcttcccgatatccgacggtagtgtaggatagtaatctataggtgcata

SEQ ID NO: 1849 - DNA, 70 bp, Artificial Sequence
  Description of Artificial Sequence: Synthetic probe
acatgggggtggtctctatgaaacacttcagcttcccgatatccgacggtagtgttgagtgaaaagagca

SEQ ID NO: 1850 - DNA, 70 bp, Artificial Sequence
  Description of Artificial Sequence: Synthetic probe
aaaaaatctgtttgtcaaagtacccttcagcttcccgatatccgacggtagtgttcaaatctgagtgctg

SEQ ID NO: 1851 - DNA, 70 bp, Artificial Sequence
  Description of Artificial Sequence: Synthetic probe
ttaaatccattaagatgattccttcagcttcccgatatccgacggtagtgttccactaaaataatctttc

SEQ ID NO: 1852 - DNA, 70 bp, Artificial Sequence
  Description of Artificial Sequence: Synthetic probe
tgagttcagacgctaatgataaaaccttcagcttcccgatatccgacggtagtgtacaaccataactgaa

SEQ ID NO: 1853 - DNA, 70 bp, Artificial Sequence
  Description of Artificial Sequence: Synthetic probe
catctgtaaaacaaaatccttcagcttcccgatatccgacggtagtgtccatttcctatgaattgtaaaa

SEQ ID NO: 1854 - DNA, 70 bp, Artificial Sequence
  Description of Artificial Sequence: Synthetic probe
ggttaactcacgctgcacttcagcttcccgatatccgacggtagtgtttcctctcataaccaaactgata

SEQ ID NO: 1855 - DNA, 70 bp, Artificial Sequence
  Description of Artificial Sequence: Synthetic probe
tacatcagttctatttttcttggcttcagcttcccgatatccgacggtagtgtaacctgagaagaaggat

SEQ ID NO: 1856 - DNA, 70 bp, Artificial Sequence
  Description of Artificial Sequence: Synthetic probe
tgagtgatatttccgttgagcttcagcttcccgatatccgacggtagtgtgtttaacacctaccgccttt

SEQ ID NO: 1857 - DNA, 70 bp, Artificial Sequence
  Description of Artificial Sequence: Synthetic probe
cccaacccccatcttccttcagcttcccgatatccgacggtagtgtagtgttaaatccattaagatgatt

SEQ ID NO: 1858 - DNA, 70 bp, Artificial Sequence
  Description of Artificial Sequence: Synthetic probe
actctgtcagagtgaaaaggcttcagcttcccgatatccgacggtagtgttgagttcagacgctaatgat

SEQ ID NO: 1859 - DNA, 70 bp, Artificial Sequence
  Description of Artificial Sequence: Synthetic probe
ctcaaagaactctggctggcttcagcttcccgatatccgacggtagtgttttaagagtataaagggtact

SEQ ID NO: 1860 - DNA, 70 bp, Artificial Sequence
  Description of Artificial Sequence: Synthetic probe
tcctgaggttcacgtccacttcagcttcccgatatccgacggtagtgtacaaaaacgtttggacactgct

SEQ ID NO: 1861 - DNA, 70 bp, Artificial Sequence
  Description of Artificial Sequence: Synthetic probe
tctaaataaagagaatgactctcttcagcttcccgatatccgacggtagtgtacaaactcgtgacaggga

SEQ ID NO: 1862 - DNA, 70 bp, Artificial Sequence
  Description of Artificial Sequence: Synthetic probe
tgaggagagcctccacccttcagcttcccgatatccgacggtagtgtcgtacagtctttccaacacacca

SEQ ID NO: 1863 - DNA, 70 bp, Artificial Sequence
  Description of Artificial Sequence: Synthetic probe
aacatctgtcagggtaacttcagcttcccgatatccgacggtagtgtgccttctaagaaaaggaaaaacg

SEQ ID NO: 1864 - DNA, 70 bp, Artificial Sequence
  Description of Artificial Sequence: Synthetic probe
acacaaactcgtgacagggcttcagcttcccgatatccgacggtagtgtaggatgacaggaaacatttgc

SEQ ID NO: 1865 - DNA, 70 bp, Artificial Sequence
  Description of Artificial Sequence: Synthetic probe
ctcgctcgggagccacttcagcttcccgatatccgacggtagtgtcacttacagcaaaatggcctcgttt

SEQ ID NO: 1866 - DNA, 70 bp, Artificial Sequence
  Description of Artificial Sequence: Synthetic probe
gaaataagaaataatcactcacttcagcttcccgatatccgacggtagtgttcaaagaactctggctgga

SEQ ID NO: 1867 - DNA, 70 bp, Artificial Sequence
  Description of Artificial Sequence: Synthetic probe
taagagccatgcataattaaggcttcagcttcccgatatccgacggtagtgtctgaggttcacgtccatg

SEQ ID NO: 1868 - DNA, 70 bp, Artificial Sequence
  Description of Artificial Sequence: Synthetic probe
tataaaaaccttcatgctaaaaacttcagcttcccgatatccgacggtagtgtggagagcctccaccagg

SEQ ID NO: 1869 - DNA, 70 bp, Artificial Sequence
  Description of Artificial Sequence: Synthetic probe
tcaaagacagatcacctgttttgcccttcagcttcccgatatccgacggtagtgtctgtcagggtaataa

SEQ ID NO: 1870 - DNA, 70 bp, Artificial Sequence
  Description of Artificial Sequence: Synthetic probe
gatgaatcttttataaagccttcagcttcccgatatccgacggtagtgttcaaaaataaaatgtaaatac

SEQ ID NO: 1871 - DNA, 70 bp, Artificial Sequence
  Description of Artificial Sequence: Synthetic probe
tccttctcagacaatttctcttcagcttcccgatatccgacggtagtgtttatatataaaggttccaatt

SEQ ID NO: 1872 - DNA, 70 bp, Artificial Sequence
  Description of Artificial Sequence: Synthetic probe
agacttctcatcatggtcacagccttcagcttcccgatatccgacggtagtgtgccgaagccagaggcag

SEQ ID NO: 1873 - DNA, 70 bp, Artificial Sequence
  Description of Artificial Sequence: Synthetic probe
tggctaataatttatagaatccttcagcttcccgatatccgacggtagtgtgctgacatggggagagaaa

SEQ ID NO: 1874 - DNA, 70 bp, Artificial Sequence
  Description of Artificial Sequence: Synthetic probe
ggagattagcttttcaaaaagacttcagcttcccgatatccgacggtagtgttgtttacatccccccctt

SEQ ID NO: 1875 - DNA, 70 bp, Artificial Sequence
  Description of Artificial Sequence: Synthetic probe
agcattgctttttcaaggccttcagcttcccgatatccgacggtagtgttctctgactaaaagaaatgat

SEQ ID NO: 1876 - DNA, 70 bp, Artificial Sequence
  Description of Artificial Sequence: Synthetic probe
ggtgccgaagccagagcttcagcttcccgatatccgacggtagtgtccaagcatctccttcaaggatttt

SEQ ID NO: 1877 - DNA, 70 bp, Artificial Sequence
  Description of Artificial Sequence: Synthetic probe
agctgacatggggagacttcagcttcccgatatccgacggtagtgtcccttcatcaaaacccagtacgta

SEQ ID NO: 1878 - DNA, 70 bp, Artificial Sequence
  Description of Artificial Sequence: Synthetic probe
ttcctttcagaaagaaataacttcagcttcccgatatccgacggtagtgtgatgaatcttttataaagca

SEQ ID NO: 1879 - DNA, 70 bp, Artificial Sequence
  Description of Artificial Sequence: Synthetic probe
attttaaacagaaatggctccttcagcttcccgatatccgacggtagtgttccttctcagacaatttctc

SEQ ID NO: 1880 - DNA, 70 bp, Artificial Sequence
  Description of Artificial Sequence: Synthetic probe
aaaaagaagattaaaaaaagcttcagcttcccgatatccgacggtagtgtggagattagcttttcaaaaa

SEQ ID NO: 1881 - DNA, 70 bp, Artificial Sequence
  Description of Artificial Sequence: Synthetic probe
aatgcaatcactaatccacttcagcttcccgatatccgacggtagtgtgcagcattgctttttcaaggct

SEQ ID NO: 1882 - DNA, 70 bp, Artificial Sequence
  Description of Artificial Sequence: Synthetic probe
acccggaatatggcagggcttcagcttcccgatatccgacggtagtgtagaggaacaggagggaatcaga

SEQ ID NO: 1883 - DNA, 70 bp, Artificial Sequence
  Description of Artificial Sequence: Synthetic probe
ctgcttgaggctgtaaaaggagaagcttcagcttcccgatatccgacggtagtgttccccatgatacagc

SEQ ID NO: 1884 - DNA, 70 bp, Artificial Sequence
  Description of Artificial Sequence: Synthetic probe
accatgagaatgtgaaatatcaccttcagcttcccgatatccgacggtagtgtaccacaacattttctga

SEQ ID NO: 1885 - DNA, 70 bp, Artificial Sequence
  Description of Artificial Sequence: Synthetic probe
gcactttctcagaaacttgccttcagcttcccgatatccgacggtagtgtgcttggaaatggaacctttt

SEQ ID NO: 1886 - DNA, 70 bp, Artificial Sequence
  Description of Artificial Sequence: Synthetic probe
tcagccaaaggagttaccttcagcttcccgatatccgacggtagtgtacatcaattactagaagaaacag

SEQ ID NO: 1887 - DNA, 70 bp, Artificial Sequence
  Description of Artificial Sequence: Synthetic probe
gctgatgtccagaaaactgcttcagcttcccgatatccgacggtagtgtacgtttacctgaacatctcat

SEQ ID NO: 1888 - DNA, 70 bp, Artificial Sequence
  Description of Artificial Sequence: Synthetic probe
tccttttggttagaagaacgacttcagcttcccgatatccgacggtagtgtcccggaatatggcagggtg

SEQ ID NO: 1889 - DNA, 70 bp, Artificial Sequence
  Description of Artificial Sequence: Synthetic probe
ttctccagagcttctacaacttcagcttcccgatatccgacggtagtgtggggcactcattaggaacctt

SEQ ID NO: 1890 - DNA, 70 bp, Artificial Sequence
  Description of Artificial Sequence: Synthetic probe
gcgtaaacacctgaatagtggcttcagcttcccgatatccgacggtagtgttgagcaaaacagtccatca

SEQ ID NO: 1891 - DNA, 70 bp, Artificial Sequence
  Description of Artificial Sequence: Synthetic probe
gatttccagggccccacttcagcttcccgatatccgacggtagtgtaattattgaaaataaagtgctctt

SEQ ID NO: 1892 - DNA, 70 bp, Artificial Sequence
  Description of Artificial Sequence: Synthetic probe
aggagtgcacacctgacttcagcttcccgatatccgacggtagtgttccaaaatactctcaacagcgtct

SEQ ID NO: 1893 - DNA, 70 bp, Artificial Sequence
  Description of Artificial Sequence: Synthetic probe
agtcagatcagaacacgtcttcagcttcccgatatccgacggtagtgttctctgggatgaatgagtaata

SEQ ID NO: 1894 - DNA, 70 bp, Artificial Sequence
  Description of Artificial Sequence: Synthetic probe
gtaatccggcaaacatgacttcagcttcccgatatccgacggtagtgtgtgatataacaaacctgcttgc

SEQ ID NO: 1895 - DNA, 70 bp, Artificial Sequence
  Description of Artificial Sequence: Synthetic probe
cactgtataagggaaaagtagcttcagcttcccgatatccgacggtagtgttctccagagcttctacaaa

SEQ ID NO: 1896 - DNA, 70 bp, Artificial Sequence
  Description of Artificial Sequence: Synthetic probe
actttttttgtgccataagccttcagcttcccgatatccgacggtagtgtgcgtaaacacctgaatagtg

SEQ ID NO: 1897 - DNA, 70 bp, Artificial Sequence
  Description of Artificial Sequence: Synthetic probe
cagtatctcaactcatcagatttcacttcagcttcccgatatccgacggtagtgtccagggccccatcgg

SEQ ID NO: 1898 - DNA, 70 bp, Artificial Sequence
  Description of Artificial Sequence: Synthetic probe
gtattcaggtcaacccagcccttcagcttcccgatatccgacggtagtgtgtcatggagaacattcattc

SEQ ID NO: 1899 - DNA, 70 bp, Artificial Sequence
  Description of Artificial Sequence: Synthetic probe
ccctgttttatatgccctgtcttcagcttcccgatatccgacggtagtgtggtaatgtgttgactggatc

SEQ ID NO: 1900 - DNA, 70 bp, Artificial Sequence
  Description of Artificial Sequence: Synthetic probe
agaaggcattcctgaggtctcttcagcttcccgatatccgacggtagtgtgcgaatgccagcctcttttc

SEQ ID NO: 1901 - DNA, 70 bp, Artificial Sequence
  Description of Artificial Sequence: Synthetic probe
tggaaccagatggggaagacttcagcttcccgatatccgacggtagtgtacttctgatggacagacattg

SEQ ID NO: 1902 - DNA, 70 bp, Artificial Sequence
  Description of Artificial Sequence: Synthetic probe
tttaatgcccacagcttcctgcttcagcttcccgatatccgacggtagtgttcctgaatagcctggggaa

SEQ ID NO: 1903 - DNA, 70 bp, Artificial Sequence
  Description of Artificial Sequence: Synthetic probe
ctccaatcacagctacccaaagcttcagcttcccgatatccgacggtagtgttggaagcatgagtagccc

SEQ ID NO: 1904 - DNA, 70 bp, Artificial Sequence
  Description of Artificial Sequence: Synthetic probe
gctctgctatgagtctgtgccttcagcttcccgatatccgacggtagtgttgggagtcttggtaattcac

SEQ ID NO: 1905 - DNA, 70 bp, Artificial Sequence
  Description of Artificial Sequence: Synthetic probe
agttattccaggcttggtggtcttcagcttcccgatatccgacggtagtgtacggacaccaagatgaacc

SEQ ID NO: 1906 - DNA, 70 bp, Artificial Sequence
  Description of Artificial Sequence: Synthetic probe
aggaagatgtcagcagagccccttcagcttcccgatatccgacggtagtgtgaaggcattcctgaggtct

SEQ ID NO: 1907 - DNA, 70 bp, Artificial Sequence
  Description of Artificial Sequence: Synthetic probe
tccatcctcatttccttggcacttcagcttcccgatatccgacggtagtgtggaaccagatggggaagag

SEQ ID NO: 1908 - DNA, 70 bp, Artificial Sequence
  Description of Artificial Sequence: Synthetic probe
gtcatggagaacattcattccttcccttcagcttcccgatatccgacggtagtgttgcccacagcttcct

SEQ ID NO: 1909 - DNA, 70 bp, Artificial Sequence
  Description of Artificial Sequence: Synthetic probe
ggtaatgtgttgactggatccccttcagcttcccgatatccgacggtagtgtccaatcacagctacccaa

SEQ ID NO: 1910 - DNA, 70 bp, Artificial Sequence
  Description of Artificial Sequence: Synthetic probe
tgggagtcttggtaattcacccttcagcttcccgatatccgacggtagtgtacttaaagacgaggttgag

SEQ ID NO: 1911 - DNA, 70 bp, Artificial Sequence
  Description of Artificial Sequence: Synthetic probe
cacggacaccaagatgacttcagcttcccgatatccgacggtagtgtgctgatctcctctctatatggtt

SEQ ID NO: 1912 - DNA, 70 bp, Artificial Sequence
  Description of Artificial Sequence: Synthetic probe
gggagaactgggtggctggcttcagcttcccgatatccgacggtagtgttccaaaacccaccagtatgga

SEQ ID NO: 1913 - DNA, 70 bp, Artificial Sequence
  Description of Artificial Sequence: Synthetic probe
aggatttcacatgttgcctctcttcagcttcccgatatccgacggtagtgtaagtgttgctgtagtagtc

SEQ ID NO: 1914 - DNA, 70 bp, Artificial Sequence
  Description of Artificial Sequence: Synthetic probe
ccttcaagaagagtgtagcctcttcagcttcccgatatccgacggtagtgtgggaactgctttatcaggg

SEQ ID NO: 1915 - DNA, 70 bp, Artificial Sequence
  Description of Artificial Sequence: Synthetic probe
tgaatgcttttgcccaaagcccttcagcttcccgatatccgacggtagtgtacctggtccagtctcacag

SEQ ID NO: 1916 - DNA, 70 bp, Artificial Sequence
  Description of Artificial Sequence: Synthetic probe
agaacaagtttctggggttactgacttcagcttcccgatatccgacggtagtgtgtctgcaggggctggg

SEQ ID NO: 1917 - DNA, 70 bp, Artificial Sequence
  Description of Artificial Sequence: Synthetic probe
tccaaagagaatcctatggaacttcagcttcccgatatccgacggtagtgtacaggtaaacgaggtccac

SEQ ID NO: 1918 - DNA, 70 bp, Artificial Sequence
  Description of Artificial Sequence: Synthetic probe
ccaaaacccaccagtatggacttcagcttcccgatatccgacggtagtgttcccctcaaggtcagtttca

SEQ ID NO: 1919 - DNA, 70 bp, Artificial Sequence
  Description of Artificial Sequence: Synthetic probe
gaagtgttgctgtagtagtcagcttcagcttcccgatatccgacggtagtgtacaaaggaatggctctcc

SEQ ID NO: 1920 - DNA, 70 bp, Artificial Sequence
  Description of Artificial Sequence: Synthetic probe
agggaactgctttatcaggggcttcagcttcccgatatccgacggtagtgttgccaattgaagagcatga

SEQ ID NO: 1921 - DNA, 70 bp, Artificial Sequence
  Description of Artificial Sequence: Synthetic probe
cattcatccatccattcaccccccttcagcttcccgatatccgacggtagtgtgtatacacctgctgtgc

SEQ ID NO: 1922 - DNA, 70 bp, Artificial Sequence
  Description of Artificial Sequence: Synthetic probe
ccatccccctatccacttcagcttcccgatatccgacggtagtgtaaagatggaaagagtagatgtgacc

SEQ ID NO: 1923 - DNA, 70 bp, Artificial Sequence
  Description of Artificial Sequence: Synthetic probe
gtgcatcatctacccagccaccccttcagcttcccgatatccgacggtagtgtggctttatctttccctg

SEQ ID NO: 1924 - DNA, 70 bp, Artificial Sequence
  Description of Artificial Sequence: Synthetic probe
tgaaaaggtcctcatctgggcttcagcttcccgatatccgacggtagtgtggtgagttcttaccgaaatc

SEQ ID NO: 1925 - DNA, 70 bp, Artificial Sequence
  Description of Artificial Sequence: Synthetic probe
ggcaggaaagagaatggagtaacttcagcttcccgatatccgacggtagtgtccctccaccacctacacc

SEQ ID NO: 1926 - DNA, 70 bp, Artificial Sequence
  Description of Artificial Sequence: Synthetic probe
gcatggccagaggggctcccttcagcttcccgatatccgacggtagtgttgtcagctacagagagagctg

SEQ ID NO: 1927 - DNA, 70 bp, Artificial Sequence
  Description of Artificial Sequence: Synthetic probe
gtagtatacacctgctgtgccttcagcttcccgatatccgacggtagtgtggatgtgaggaagaatacgt

SEQ ID NO: 1928 - DNA, 70 bp, Artificial Sequence
  Description of Artificial Sequence: Synthetic probe
tggaaagagtagatgtgaccatcaccttcagcttcccgatatccgacggtagtgtggtgtgggagcgggc

SEQ ID NO: 1929 - DNA, 70 bp, Artificial Sequence
  Description of Artificial Sequence: Synthetic probe
gtcggctttatctttccctgcttcagcttcccgatatccgacggtagtgtgtgccacaactcttaatcag

SEQ ID NO: 1930 - DNA, 70 bp, Artificial Sequence
  Description of Artificial Sequence: Synthetic probe
tttttgtaaattaaagccagtactcttcagcttcccgatatccgacggtagtgtgcccagaatcccaacc

SEQ ID NO: 1931 - DNA, 70 bp, Artificial Sequence
  Description of Artificial Sequence: Synthetic probe
gcaaacttaggtgctctcagtcttcagcttcccgatatccgacggtagtgttcgtgacagacagacattc

SEQ ID NO: 1932 - DNA, 70 bp, Artificial Sequence
  Description of Artificial Sequence: Synthetic probe
gcccctgcagaaatgttggacttcagcttcccgatatccgacggtagtgttgaggaaaatgagcagcaag

SEQ ID NO: 1933 - DNA, 70 bp, Artificial Sequence
  Description of Artificial Sequence: Synthetic probe
tgcagatccttcagcaaagacttcagcttcccgatatccgacggtagtgttgacaggactccagcaacaa

SEQ ID NO: 1934 - DNA, 70 bp, Artificial Sequence
  Description of Artificial Sequence: Synthetic probe
agaggcaaccataacagaacaccttcagcttcccgatatccgacggtagtgtagggagtcagatcagccc

SEQ ID NO: 1935 - DNA, 70 bp, Artificial Sequence
  Description of Artificial Sequence: Synthetic probe
atgacattcaagcacctgcaaccttcagcttcccgatatccgacggtagtgtcggaatggggtttggggg

SEQ ID NO: 1936 - DNA, 70 bp, Artificial Sequence
  Description of Artificial Sequence: Synthetic probe
cacagcccagaatcccaaccttcagcttcccgatatccgacggtagtgtgggattttgtcctgattaggg

SEQ ID NO: 1937 - DNA, 70 bp, Artificial Sequence
  Description of Artificial Sequence: Synthetic probe
ttcgtgacagacagacattcagccttcagcttcccgatatccgacggtagtgtacaggatgtggctggaa

SEQ ID NO: 1938 - DNA, 70 bp, Artificial Sequence
  Description of Artificial Sequence: Synthetic probe
tgaggaaaatgagcagcacttcagcttcccgatatccgacggtagtgtccacagaaatgctaacagtact

SEQ ID NO: 1939 - DNA, 70 bp, Artificial Sequence
  Description of Artificial Sequence: Synthetic probe
ggcagatgggagggtcgcctcttcagcttcccgatatccgacggtagtgttgtggctgaaagtttctgca

SEQ ID NO: 1940 - DNA, 70 bp, Artificial Sequence
  Description of Artificial Sequence: Synthetic probe
gcgactgtggaattaaatcaccttcagcttcccgatatccgacggtagtgtggctggcattatagatgct

SEQ ID NO: 1941 - DNA, 70 bp, Artificial Sequence
  Description of Artificial Sequence: Synthetic probe
cccagtcccttgagcagcacttcagcttcccgatatccgacggtagtgtcctgtacatgctggagttgag

SEQ ID NO: 1942 - DNA, 70 bp, Artificial Sequence
  Description of Artificial Sequence: Synthetic probe
ctccagagtccacaggaggtcttcagcttcccgatatccgacggtagtgtgctgagtttccccttgcagc

SEQ ID NO: 1943 - DNA, 70 bp, Artificial Sequence
  Description of Artificial Sequence: Synthetic probe
gctgctcgcaccacctcttcagcttcccgatatccgacggtagtgtatagagctgaggcggaatgggagc

SEQ ID NO: 1944 - DNA, 70 bp, Artificial Sequence
  Description of Artificial Sequence: Synthetic probe
gtggtgtcaatgtggacccacttcagcttcccgatatccgacggtagtgtaggaggacgagggaggctac

SEQ ID NO: 1945 - DNA, 70 bp, Artificial Sequence
  Description of Artificial Sequence: Synthetic probe
gttcttgaggaggctggcacttcagcttcccgatatccgacggtagtgtggggtttcaaggagtcaaaga

SEQ ID NO: 1946 - DNA, 70 bp, Artificial Sequence
  Description of Artificial Sequence: Synthetic probe
gccccaggccaaagagcgcttcagcttcccgatatccgacggtagtgtgtagaagaccagctcgacttgg

SEQ ID NO: 1947 - DNA, 70 bp, Artificial Sequence
  Description of Artificial Sequence: Synthetic probe
ctgtacatgctggagttgagcttcagcttcccgatatccgacggtagtgtgcactcttgcagaaggacaa

SEQ ID NO: 1948 - DNA, 70 bp, Artificial Sequence
  Description of Artificial Sequence: Synthetic probe
gctgagtttccccttgcagctctcttcagcttcccgatatccgacggtagtgtgacggatgccaggggca

SEQ ID NO: 1949 - DNA, 70 bp, Artificial Sequence
  Description of Artificial Sequence: Synthetic probe
agctgaggcggaatgggagccaccttcagcttcccgatatccgacggtagtgtgggcgaggcagtagggg

SEQ ID NO: 1950 - DNA, 70 bp, Artificial Sequence
  Description of Artificial Sequence: Synthetic probe
aggaggacgagggaggctacaacttcagcttcccgatatccgacggtagtgtcttcttgtgcggctggcc

SEQ ID NO: 1951 - DNA, 70 bp, Artificial Sequence
  Description of Artificial Sequence: Synthetic probe
gagtgggtgacatgcccttcagcttcccgatatccgacggtagtgtggaagaaggtaatgagaaaatatt

SEQ ID NO: 1952 - DNA, 70 bp, Artificial Sequence
  Description of Artificial Sequence: Synthetic probe
gggtttcaaggagtcaaagacgcttcagcttcccgatatccgacggtagtgtgaagactccacatctctt

SEQ ID NO: 1953 - DNA, 70 bp, Artificial Sequence
  Description of Artificial Sequence: Synthetic probe
agaagaccagctcgacttgggcttcagcttcccgatatccgacggtagtgttggcatggttgttgacttt

SEQ ID NO: 1954 - DNA, 70 bp, Artificial Sequence
  Description of Artificial Sequence: Synthetic probe
gcactcttgcagaaggaccttcagcttcccgatatccgacggtagtgtgcttcaaatagtagtcctcctc

SEQ ID NO: 1955 - DNA, 70 bp, Artificial Sequence
  Description of Artificial Sequence: Synthetic probe
actgacggatgccaggggccttcagcttcccgatatccgacggtagtgtttgctccaaataccagtgccc

SEQ ID NO: 1956 - DNA, 70 bp, Artificial Sequence
  Description of Artificial Sequence: Synthetic probe
cctgggcgaggcagtagggcttcagcttcccgatatccgacggtagtgtgacggcagaatggatggcatg

SEQ ID NO: 1957 - DNA, 70 bp, Artificial Sequence
  Description of Artificial Sequence: Synthetic probe
gacttcttgtgcggctggccttcagcttcccgatatccgacggtagtgttctgccatccgtgatttaatt

SEQ ID NO: 1958 - DNA, 70 bp, Artificial Sequence
  Description of Artificial Sequence: Synthetic probe
acctttgctagaggtgggtttgcttcagcttcccgatatccgacggtagtgtccgatggcgaagctgaac

SEQ ID NO: 1959 - DNA, 70 bp, Artificial Sequence
  Description of Artificial Sequence: Synthetic probe
ctgtgagagataggaaggatttggcttcagcttcccgatatccgacggtagtgtgtcccttgagcagcag

SEQ ID NO: 1960 - DNA, 70 bp, Artificial Sequence
  Description of Artificial Sequence: Synthetic probe
aatgcctgagtggaagaaagcacttcagcttcccgatatccgacggtagtgtccagagtccacaggaggt

SEQ ID NO: 1961 - DNA, 70 bp, Artificial Sequence
  Description of Artificial Sequence: Synthetic probe
tgtggctgaaagtttctgcaacacttcagcttcccgatatccgacggtagtgtgctcgcaccacctctgg

SEQ ID NO: 1962 - DNA, 70 bp, Artificial Sequence
  Description of Artificial Sequence: Synthetic probe
aggctggcattatagatgctgtcttcagcttcccgatatccgacggtagtgtggtgtcaatgtggaccca

SEQ ID NO: 1963 - DNA, 70 bp, Artificial Sequence
  Description of Artificial Sequence: Synthetic probe
gaaggtaatgagaaaatatttcttgcttcagcttcccgatatccgacggtagtgttgaggaggctggcaa

SEQ ID NO: 1964 - DNA, 70 bp, Artificial Sequence
  Description of Artificial Sequence: Synthetic probe
atccgatggcgaagctgaacagcttcagcttcccgatatccgacggtagtgtcccaggccaaagagcgtg

SEQ ID NO: 1965 - DNA, 70 bp, Artificial Sequence
  Description of Artificial Sequence: Synthetic probe
gaaaactccatcccctcagggtcacttcagcttcccgatatccgacggtagtgtccctccatctgtgcct

SEQ ID NO: 1966 - DNA, 70 bp, Artificial Sequence
  Description of Artificial Sequence: Synthetic probe
tagatgaagagaagacttcagcttcccgatatccgacggtagtgttgctcaaagagccatgatggccctg

SEQ ID NO: 1967 - DNA, 70 bp, Artificial Sequence
  Description of Artificial Sequence: Synthetic probe
tccagagtctctgaaggacttcagcttcccgatatccgacggtagtgttcaaagagagtctgtcattcat

SEQ ID NO: 1968 - DNA, 70 bp, Artificial Sequence
  Description of Artificial Sequence: Synthetic probe
tccactaaacaaaaacaaggacttcagcttcccgatatccgacggtagtgtccagtgccaggattccaga

SEQ ID NO: 1969 - DNA, 70 bp, Artificial Sequence
  Description of Artificial Sequence: Synthetic probe
ggtacctgccttagctcttcagcttcccgatatccgacggtagtgtgcactgtgacaatgctgattggga

SEQ ID NO: 1970 - DNA, 70 bp, Artificial Sequence
  Description of Artificial Sequence: Synthetic probe
aggttagccctgcaagtcttcagcttcccgatatccgacggtagtgttctctctcttacctctctggaag

SEQ ID NO: 1971 - DNA, 70 bp, Artificial Sequence
  Description of Artificial Sequence: Synthetic probe
cgaccacaacagcagagcccttcagcttcccgatatccgacggtagtgtagcccacagcaggatccttga

SEQ ID NO: 1972 - DNA, 70 bp, Artificial Sequence
  Description of Artificial Sequence: Synthetic probe
atgcatcagtgccactgcgcttcagcttcccgatatccgacggtagtgtaagaggcacatccttagagga

SEQ ID NO: 1973 - DNA, 70 bp, Artificial Sequence
  Description of Artificial Sequence: Synthetic probe
tcgttcttctgactggcaaccttcagcttcccgatatccgacggtagtgtggagcagggaggagaagctg

SEQ ID NO: 1974 - DNA, 70 bp, Artificial Sequence
  Description of Artificial Sequence: Synthetic probe
ccactctctgggagccctcacttcagcttcccgatatccgacggtagtgtgtgatcctgccaaggccccc

SEQ ID NO: 1975 - DNA, 70 bp, Artificial Sequence
  Description of Artificial Sequence: Synthetic probe
gaacttgctgaatgtgggaacttcagcttcccgatatccgacggtagtgttgtcttcagcccacttccca

SEQ ID NO: 1976 - DNA, 70 bp, Artificial Sequence
  Description of Artificial Sequence: Synthetic probe
ggtcagagtccctcggggcttcagcttcccgatatccgacggtagtgtctcaccattgccctcaccggtt

SEQ ID NO: 1977 - DNA, 70 bp, Artificial Sequence
  Description of Artificial Sequence: Synthetic probe
catgaaaccctcatctaagaagcttcagcttcccgatatccgacggtagtgtaccacaacagcagagcca

SEQ ID NO: 1978 - DNA, 70 bp, Artificial Sequence
  Description of Artificial Sequence: Synthetic probe
cccacccacggacccaccttcagcttcccgatatccgacggtagtgtgggatgcatcagtgccactgcgt

SEQ ID NO: 1979 - DNA, 70 bp, Artificial Sequence
  Description of Artificial Sequence: Synthetic probe
tcctgcagaggctctgcccttcagcttcccgatatccgacggtagtgtggtcgttcttctgactggcaac

SEQ ID NO: 1980 - DNA, 70 bp, Artificial Sequence
  Description of Artificial Sequence: Synthetic probe
tctaggcctggagccatgccttcagcttcccgatatccgacggtagtgtcccactctctgggagccctca

SEQ ID NO: 1981 - DNA, 70 bp, Artificial Sequence
  Description of Artificial Sequence: Synthetic probe
cactggcgacgccacaggtcttcagcttcccgatatccgacggtagtgttgagtcacccaaaccattgcc

SEQ ID NO: 1982 - DNA, 70 bp, Artificial Sequence
  Description of Artificial Sequence: Synthetic probe
gaatggagtagccaggtgacttcagcttcccgatatccgacggtagtgtggcttacgtcgctgtaagctc

SEQ ID NO: 1983 - DNA, 70 bp, Artificial Sequence
  Description of Artificial Sequence: Synthetic probe
ctccaggaagcccacagcagcttcagcttcccgatatccgacggtagtgtggccctgctgtgccctcttt

SEQ ID NO: 1984 - DNA, 70 bp, Artificial Sequence
  Description of Artificial Sequence: Synthetic probe
ttgatggtaagaggcacatcccttcagcttcccgatatccgacggtagtgtagacagcgtgtgagctgac

SEQ ID NO: 1985 - DNA, 70 bp, Artificial Sequence
  Description of Artificial Sequence: Synthetic probe
aggagctagggagcagggcttcagcttcccgatatccgacggtagtgtgtccctttaatgcccaggctga

SEQ ID NO: 1986 - DNA, 70 bp, Artificial Sequence
  Description of Artificial Sequence: Synthetic probe
gctgagagtgtgatcctgccttcagcttcccgatatccgacggtagtgtagtgcctccttgagtatctgc

SEQ ID NO: 1987 - DNA, 70 bp, Artificial Sequence
  Description of Artificial Sequence: Synthetic probe
ccccaacgctgtcttcagccttcagcttcccgatatccgacggtagtgttcactggcgacgccacaggta

SEQ ID NO: 1988 - DNA, 70 bp, Artificial Sequence
  Description of Artificial Sequence: Synthetic probe
cccagacctcaccattgcccttcagcttcccgatatccgacggtagtgttgaatggagtagccaggtgag

SEQ ID NO: 1989 - DNA, 70 bp, Artificial Sequence
  Description of Artificial Sequence: Synthetic probe
ggtttagcacgaccacaacagcttcagcttcccgatatccgacggtagtgttccaggaagcccacagcag

SEQ ID NO: 1990 - DNA, 70 bp, Artificial Sequence
  Description of Artificial Sequence: Synthetic probe
gccatcgggatgcatcacttcagcttcccgatatccgacggtagtgttccttgatggtaagaggcacatc

SEQ ID NO: 1991 - DNA, 70 bp, Artificial Sequence
  Description of Artificial Sequence: Synthetic probe
tgatgcccacgacactgcccttcagcttcccgatatccgacggtagtgtaatcctcaccccaaagttggt

SEQ ID NO: 1992 - DNA, 70 bp, Artificial Sequence
  Description of Artificial Sequence: Synthetic probe
agaagcaatcctgtgaggcttcagcttcccgatatccgacggtagtgtagtcactcaaaaggatttattg

SEQ ID NO: 1993 - DNA, 70 bp, Artificial Sequence
  Description of Artificial Sequence: Synthetic probe
ccatgatgcttaccctcttcagcttcccgatatccgacggtagtgtgcacctactaaaagtctaccacca

SEQ ID NO: 1994 - DNA, 70 bp, Artificial Sequence
  Description of Artificial Sequence: Synthetic probe
cttgggacattcctgaggacttcagcttcccgatatccgacggtagtgtactggaaggctaccaaaggac

SEQ ID NO: 1995 - DNA, 70 bp, Artificial Sequence
  Description of Artificial Sequence: Synthetic probe
gaggaatgactgaaaagcaagcttcagcttcccgatatccgacggtagtgtgcagaagggaggctctgtg

SEQ ID NO: 1996 - DNA, 70 bp, Artificial Sequence
  Description of Artificial Sequence: Synthetic probe
tctccacccctcaactactccttcagcttcccgatatccgacggtagtgttccccactgccttgactcac

SEQ ID NO: 1997 - DNA, 70 bp, Artificial Sequence
  Description of Artificial Sequence: Synthetic probe
ggcagggcttagctgccttcttcagcttcccgatatccgacggtagtgtctgatgcccacgacactgcct

SEQ ID NO: 1998 - DNA, 70 bp, Artificial Sequence
  Description of Artificial Sequence: Synthetic probe
cccatggcccggtctcccttcagcttcccgatatccgacggtagtgtagtagaagcaatcctgtgaggct

SEQ ID NO: 1999 - DNA, 70 bp, Artificial Sequence
  Description of Artificial Sequence: Synthetic probe
ttaggacaaggcccacagcttcagcttcccgatatccgacggtagtgtagccatgatgcttaccctactc

SEQ ID NO: 2000 - DNA, 70 bp, Artificial Sequence
  Description of Artificial Sequence: Synthetic probe
tagcctggatgggcccccttcagcttcccgatatccgacggtagtgtgggtcagtagcaggcctgaggac

SEQ ID NO: 2001 - DNA, 70 bp, Artificial Sequence
  Description of Artificial Sequence: Synthetic probe
ctccatccgtcgcccacttcagcttcccgatatccgacggtagtgttccacagggaataagggtatcagt

SEQ ID NO: 2002 - DNA, 70 bp, Artificial Sequence
  Description of Artificial Sequence: Synthetic probe
ctgaacacggtttcaaaatcttcagcttcccgatatccgacggtagtgtaggagtcacagtatgtggcat

SEQ ID NO: 2003 - DNA, 70 bp, Artificial Sequence
  Description of Artificial Sequence: Synthetic probe
ccccttggccgggcgcttcagcttcccgatatccgacggtagtgttgcagacacacaccaccgagctgta

SEQ ID NO: 2004 - DNA, 70 bp, Artificial Sequence
  Description of Artificial Sequence: Synthetic probe
cacctgtaatcctagcacttcttcagcttcccgatatccgacggtagtgtagcttttagggatgcagggg

SEQ ID NO: 2005 - DNA, 70 bp, Artificial Sequence
  Description of Artificial Sequence: Synthetic probe
ctctcatagcggctgaaggcttcagcttcccgatatccgacggtagtgtagcgggaaactccatggtgat

SEQ ID NO: 2006 - DNA, 70 bp, Artificial Sequence
  Description of Artificial Sequence: Synthetic probe
gggcaggaaaggtcggcttcagcttcccgatatccgacggtagtgtactgacaccatttacctctaggag

SEQ ID NO: 2007 - DNA, 70 bp, Artificial Sequence
  Description of Artificial Sequence: Synthetic probe
ggagtcacagtatgtggcattgcttcagcttcccgatatccgacggtagtgtcctggcccagggggtgag

SEQ ID NO: 2008 - DNA, 70 bp, Artificial Sequence
  Description of Artificial Sequence: Synthetic probe
acacacaccaccgagctgcttcagcttcccgatatccgacggtagtgttgtaatggttacctgtgcccgt

SEQ ID NO: 2009 - DNA, 70 bp, Artificial Sequence
  Description of Artificial Sequence: Synthetic probe
agcttttagggatgcaggggccttcagcttcccgatatccgacggtagtgtagcctggatgggccccata

SEQ ID NO: 2010 - DNA, 70 bp, Artificial Sequence
  Description of Artificial Sequence: Synthetic probe
acctgggagggagggagtaccttcagcttcccgatatccgacggtagtgtctccatccgtcgcccactgc

SEQ ID NO: 2011 - DNA, 70 bp, Artificial Sequence
  Description of Artificial Sequence: Synthetic probe
gagtgaggtctgatgaagacatggacttcagcttcccgatatccgacggtagtgtatagcggctgaaggt

SEQ ID NO: 2012 - DNA, 70 bp, Artificial Sequence
  Description of Artificial Sequence: Synthetic probe
gaatggacacatctgctaggagcttcagcttcccgatatccgacggtagtgtgcaggaaaggtcgggggg

SEQ ID NO: 2013 - DNA, 70 bp, Artificial Sequence
  Description of Artificial Sequence: Synthetic probe
ttcttcagagaagtacgatttcttcagcttcccgatatccgacggtagtgtttgctgtgaggggagatca

SEQ ID NO: 2014 - DNA, 70 bp, Artificial Sequence
  Description of Artificial Sequence: Synthetic probe
agcaaattttgggcagggggcttcagcttcccgatatccgacggtagtgtctgcactcctgtctcgccga

SEQ ID NO: 2015 - DNA, 70 bp, Artificial Sequence
  Description of Artificial Sequence: Synthetic probe
tgaggggtgtaatggttcttcagcttcccgatatccgacggtagtgtcccttcactttctggaacttctg

SEQ ID NO: 2016 - DNA, 70 bp, Artificial Sequence
  Description of Artificial Sequence: Synthetic probe
gggcaaggatgttgagagcacttcagcttcccgatatccgacggtagtgttgggcagagtgagattctgc

SEQ ID NO: 2017 - DNA, 70 bp, Artificial Sequence
  Description of Artificial Sequence: Synthetic probe
atctgtcatggcccccttcagcttcccgatatccgacggtagtgtctcaaaaaaattttaaaaaaagaaa

SEQ ID NO: 2018 - DNA, 70 bp, Artificial Sequence
  Description of Artificial Sequence: Synthetic probe
ttcactttctggaacttctgttccttcagcttcccgatatccgacggtagtgtgaaaagtttcaatggct

SEQ ID NO: 2019 - DNA, 70 bp, Artificial Sequence
  Description of Artificial Sequence: Synthetic probe
gctgcagggtcagtagcacttcagcttcccgatatccgacggtagtgttgtcatcttgtccccttcctcc

SEQ ID NO: 2020 - DNA, 70 bp, Artificial Sequence
  Description of Artificial Sequence: Synthetic probe
ggacatccacagggaacttcagcttcccgatatccgacggtagtgtcaccttcttcagagaagtacgatt

SEQ ID NO: 2021 - DNA, 70 bp, Artificial Sequence
  Description of Artificial Sequence: Synthetic probe
cagtacccagcgggaaactccttcagcttcccgatatccgacggtagtgtagcaaattttgggcaggggg

SEQ ID NO: 2022 - DNA, 70 bp, Artificial Sequence
  Description of Artificial Sequence: Synthetic probe
tgatcactgacaccatttacccttcagcttcccgatatccgacggtagtgtggcaaggatgttgagagca

SEQ ID NO: 2023 - DNA, 70 bp, Artificial Sequence
  Description of Artificial Sequence: Synthetic probe
ggaggacccagcctggccttcagcttcccgatatccgacggtagtgtagcatctgtcatggcccctccaa

SEQ ID NO: 2024 - DNA, 70 bp, Artificial Sequence
  Description of Artificial Sequence: Synthetic probe
cttcctctgggaggctgaacttcagcttcccgatatccgacggtagtgtcagccattagcctccaccctc

SEQ ID NO: 2025 - DNA, 70 bp, Artificial Sequence
  Description of Artificial Sequence: Synthetic probe
caactggaaatcatcaggggcttcagcttcccgatatccgacggtagtgtcccaggacaaaacagcaggg

SEQ ID NO: 2026 - DNA, 70 bp, Artificial Sequence
  Description of Artificial Sequence: Synthetic probe
gcataggtgtaggtgcggcttcagcttcccgatatccgacggtagtgtaaaatgtctgtacaagcagacc

SEQ ID NO: 2027 - DNA, 70 bp, Artificial Sequence
  Description of Artificial Sequence: Synthetic probe
agtcacagctggccatggcttcagcttcccgatatccgacggtagtgtcctacagtttctcaacccccag

SEQ ID NO: 2028 - DNA, 70 bp, Artificial Sequence
  Description of Artificial Sequence: Synthetic probe
gatgatgttatatccgattcctcttcagcttcccgatatccgacggtagtgtggccctcagggcctgaaa

SEQ ID NO: 2029 - DNA, 70 bp, Artificial Sequence
  Description of Artificial Sequence: Synthetic probe
gaaaaggatgatcaagatatggtcttcagcttcccgatatccgacggtagtgtatgcctaccttgagctt

SEQ ID NO: 2030 - DNA, 70 bp, Artificial Sequence
  Description of Artificial Sequence: Synthetic probe
tccgagtcaataggagagtcttcagcttcccgatatccgacggtagtgttcttcctctgggaggctgaag

SEQ ID NO: 2031 - DNA, 70 bp, Artificial Sequence
  Description of Artificial Sequence: Synthetic probe
ctctgcttatcacttgccacttcagcttcccgatatccgacggtagtgtgcaactggaaatcatcagggg

SEQ ID NO: 2032 - DNA, 70 bp, Artificial Sequence
  Description of Artificial Sequence: Synthetic probe
atagtgtctgagtcagggcccttcagcttcccgatatccgacggtagtgtgcataggtgtaggtgcggat

SEQ ID NO: 2033 - DNA, 70 bp, Artificial Sequence
  Description of Artificial Sequence: Synthetic probe
gaacttgggctcctgggttgcttcagcttcccgatatccgacggtagtgtagtcacagctggccatgggt

SEQ ID NO: 2034 - DNA, 70 bp, Artificial Sequence
  Description of Artificial Sequence: Synthetic probe
tatctggcccaggtctggtcttcagcttcccgatatccgacggtagtgtcaaggctgaaaggcccagaag

SEQ ID NO: 2035 - DNA, 70 bp, Artificial Sequence
  Description of Artificial Sequence: Synthetic probe
tgtctccgggctgtccccttcagcttcccgatatccgacggtagtgtagaaaggtgagctgaggacaggc

SEQ ID NO: 2036 - DNA, 70 bp, Artificial Sequence
  Description of Artificial Sequence: Synthetic probe
ccaccctcccacccccagcttcagcttcccgatatccgacggtagtgtccaggggctggcaaggagtgaa

SEQ ID NO: 2037 - DNA, 70 bp, Artificial Sequence
  Description of Artificial Sequence: Synthetic probe
cagcaggggacaaaatgtctgtcttcagcttcccgatatccgacggtagtgtgctgggccaactgcaggg

SEQ ID NO: 2038 - DNA, 70 bp, Artificial Sequence
  Description of Artificial Sequence: Synthetic probe
ccccttcccattcaccgccttcagcttcccgatatccgacggtagtgttctggaagtggaactaggttga

SEQ ID NO: 2039 - DNA, 70 bp, Artificial Sequence
  Description of Artificial Sequence: Synthetic probe
gtcttgagccaagtgggtgcttcagcttcccgatatccgacggtagtgttgggacacagatcagcatggc

SEQ ID NO: 2040 - DNA, 70 bp, Artificial Sequence
  Description of Artificial Sequence: Synthetic probe
aggggctggcaaggagtgcttcagcttcccgatatccgacggtagtgtatgggaggccagtcctgatccc

SEQ ID NO: 2041 - DNA, 70 bp, Artificial Sequence
  Description of Artificial Sequence: Synthetic probe
acgctgggccaactgccttcagcttcccgatatccgacggtagtgtcatccttgctgatcccttacttca

SEQ ID NO: 2042 - DNA, 70 bp, Artificial Sequence
  Description of Artificial Sequence: Synthetic probe
tgaatcaggggtatctagagacacttcagcttcccgatatccgacggtagtgtctggcccaggtctggtg

SEQ ID NO: 2043 - DNA, 70 bp, Artificial Sequence
  Description of Artificial Sequence: Synthetic probe
ggtagtgaagagagaagcaccccttcagcttcccgatatccgacggtagtgttctccgggctgtcccttg

SEQ ID NO: 2044 - DNA, 70 bp, Artificial Sequence
  Description of Artificial Sequence: Synthetic probe
gttggaacacatactagcccacttcagcttcccgatatccgacggtagtgtcccttcccattcaccgctc

SEQ ID NO: 2045 - DNA, 70 bp, Artificial Sequence
  Description of Artificial Sequence: Synthetic probe
gtgcatccggttcagccacttcagcttcccgatatccgacggtagtgttggtcttgagccaagtgggtga

SEQ ID NO: 2046 - DNA, 70 bp, Artificial Sequence
  Description of Artificial Sequence: Synthetic probe
acctttgcccagtggggcacttcagcttcccgatatccgacggtagtgtaactgtgggatccatggcacc

SEQ ID NO: 2047 - DNA, 70 bp, Artificial Sequence
  Description of Artificial Sequence: Synthetic probe
agcgttggtcatccagcatcttcagcttcccgatatccgacggtagtgtaggtccaggggaatggtgctc

SEQ ID NO: 2048 - DNA, 70 bp, Artificial Sequence
  Description of Artificial Sequence: Synthetic probe
ggtcatgaatgatccggcccttcagcttcccgatatccgacggtagtgtgcaatgaagtctcgctgatgt

SEQ ID NO: 2049 - DNA, 70 bp, Artificial Sequence
  Description of Artificial Sequence: Synthetic probe
gtggaccagaccagctgggcttcagcttcccgatatccgacggtagtgtgggtgaagcccaggcactgga

SEQ ID NO: 2050 - DNA, 70 bp, Artificial Sequence
  Description of Artificial Sequence: Synthetic probe
ggctcacacctgtaatcccagcttcagcttcccgatatccgacggtagtgtatccactcaacagcccagc

SEQ ID NO: 2051 - DNA, 70 bp, Artificial Sequence
  Description of Artificial Sequence: Synthetic probe
ttgggaagccgaggcaggcttcagcttcccgatatccgacggtagtgtaggctcattttcagctgtcact

SEQ ID NO: 2052 - DNA, 70 bp, Artificial Sequence
  Description of Artificial Sequence: Synthetic probe
cttgagttcaggagttcgacttcagcttcccgatatccgacggtagtgtagaactgtaacttgtgctcag

SEQ ID NO: 2053 - DNA, 70 bp, Artificial Sequence
  Description of Artificial Sequence: Synthetic probe
gcggacattgtggtgagtcttcagcttcccgatatccgacggtagtgtgaatccatagttgggtagagaa

SEQ ID NO: 2054 - DNA, 70 bp, Artificial Sequence
  Description of Artificial Sequence: Synthetic probe
gcgagggtaggacctaggcttcagcttcccgatatccgacggtagtgtgctctaagtttgggagccagtc

SEQ ID NO: 2055 - DNA, 70 bp, Artificial Sequence
  Description of Artificial Sequence: Synthetic probe
caatgaagtctcgctgatgcttcagcttcccgatatccgacggtagtgtggatgctggatttgaaggtca

SEQ ID NO: 2056 - DNA, 70 bp, Artificial Sequence
  Description of Artificial Sequence: Synthetic probe
ggtgaagcccaggcactggcttcagcttcccgatatccgacggtagtgtagcaccatggaggtccaggcc

SEQ ID NO: 2057 - DNA, 70 bp, Artificial Sequence
  Description of Artificial Sequence: Synthetic probe
tatccactcaacagcccagcacttcagcttcccgatatccgacggtagtgtcctttgcccagtggggcag

SEQ ID NO: 2058 - DNA, 70 bp, Artificial Sequence
  Description of Artificial Sequence: Synthetic probe
gctcattttcagctgtcactcttcagcttcccgatatccgacggtagtgtagcgttggtcatccagcatg

SEQ ID NO: 2059 - DNA, 70 bp, Artificial Sequence
  Description of Artificial Sequence: Synthetic probe
gaactgtaacttgtgctcacttcagcttcccgatatccgacggtagtgtggcggacattgtggtgagtac

SEQ ID NO: 2060 - DNA, 70 bp, Artificial Sequence
  Description of Artificial Sequence: Synthetic probe
gcatccaggaacctggcaagagacttcagcttcccgatatccgacggtagtgtagggtaggacctaggtc

SEQ ID NO: 2061 - DNA, 70 bp, Artificial Sequence
  Description of Artificial Sequence: Synthetic probe
tgatgatgctgtggctgtcttcagcttcccgatatccgacggtagtgtgggaagatagggaatcatggtt

SEQ ID NO: 2062 - DNA, 70 bp, Artificial Sequence
  Description of Artificial Sequence: Synthetic probe
ccctcgatcccaggagcccttcagcttcccgatatccgacggtagtgtcagagttgctcaaaagggcagg

SEQ ID NO: 2063 - DNA, 70 bp, Artificial Sequence
  Description of Artificial Sequence: Synthetic probe
accttgcacacaggcttctcttcagcttcccgatatccgacggtagtgtgcatggtgttggggaacaggc

SEQ ID NO: 2064 - DNA, 70 bp, Artificial Sequence
  Description of Artificial Sequence: Synthetic probe
tctagttcctgttgtaggaatcctgcttcagcttcccgatatccgacggtagtgtccctagggtggcttt

SEQ ID NO: 2065 - DNA, 70 bp, Artificial Sequence
  Description of Artificial Sequence: Synthetic probe
gagttgggtgacgggaagcttcagcttcccgatatccgacggtagtgttggagccagaaagtccaggtac

SEQ ID NO: 2066 - DNA, 70 bp, Artificial Sequence
  Description of Artificial Sequence: Synthetic probe
ctagagaggtttggggagacttcagcttcccgatatccgacggtagtgtgtacagcaatgccatgaacat

SEQ ID NO: 2067 - DNA, 70 bp, Artificial Sequence
  Description of Artificial Sequence: Synthetic probe
tttgtttttgagacaggatgcttcagcttcccgatatccgacggtagtgtgctgcttctgggtctgtcag

SEQ ID NO: 2068 - DNA, 70 bp, Artificial Sequence
  Description of Artificial Sequence: Synthetic probe
acactctgctcccagaactcttcagcttcccgatatccgacggtagtgtctggggaaagctggacaggaa

SEQ ID NO: 2069 - DNA, 70 bp, Artificial Sequence
  Description of Artificial Sequence: Synthetic probe
ccacacaggcctctgacttcagcttcccgatatccgacggtagtgtggcttctgtcagtctttggtgaaa

SEQ ID NO: 2070 - DNA, 70 bp, Artificial Sequence
  Description of Artificial Sequence: Synthetic probe
catggtgttggggaacaggcttcagcttcccgatatccgacggtagtgttaagaggtctgaggtctgctt

SEQ ID NO: 2071 - DNA, 70 bp, Artificial Sequence
  Description of Artificial Sequence: Synthetic probe
gtctcccctagggtggcttcttcagcttcccgatatccgacggtagtgtggaagggagactggggtggct

SEQ ID NO: 2072 - DNA, 70 bp, Artificial Sequence
  Description of Artificial Sequence: Synthetic probe
gagccagaaagtccaggtaccttcagcttcccgatatccgacggtagtgttgatgatgctgtggctgtac

SEQ ID NO: 2073 - DNA, 70 bp, Artificial Sequence
  Description of Artificial Sequence: Synthetic probe
tacagcaatgccatgaacatcttcagcttcccgatatccgacggtagtgtccctcgatcccaggagccta

SEQ ID NO: 2074 - DNA, 70 bp, Artificial Sequence
  Description of Artificial Sequence: Synthetic probe
gctgcttctgggtctgtccttcagcttcccgatatccgacggtagtgtgcacactctgctcccagaactt

SEQ ID NO: 2075 - DNA, 70 bp, Artificial Sequence
  Description of Artificial Sequence: Synthetic probe
gcaaaggaagagcaactgatcccttcagcttcccgatatccgacggtagtgtacacaggcctctgaggca

SEQ ID NO: 2076 - DNA, 70 bp, Artificial Sequence
  Description of Artificial Sequence: Synthetic probe
gtggccaaggtggtagaacatgggccttcagcttcccgatatccgacggtagtgtgcaaaaggggatggg

SEQ ID NO: 2077 - DNA, 70 bp, Artificial Sequence
  Description of Artificial Sequence: Synthetic probe
tgtttgtaaaacgtgtcttcagcttcccgatatccgacggtagtgtgtgcctcttccgaggttccaccct

SEQ ID NO: 2078 - DNA, 70 bp, Artificial Sequence
  Description of Artificial Sequence: Synthetic probe
tgggtaggtcagccctgtgcttcagcttcccgatatccgacggtagtgttccttcggggttcagggcaag

SEQ ID NO: 2079 - DNA, 70 bp, Artificial Sequence
  Description of Artificial Sequence: Synthetic probe
acattccttagtagctaaggagtcttcagcttcccgatatccgacggtagtgtcggtccagccgaccaca

SEQ ID NO: 2080 - DNA, 70 bp, Artificial Sequence
  Description of Artificial Sequence: Synthetic probe
tgtctacaatgatgggactgtcgcttcagcttcccgatatccgacggtagtgttcctgctccctcgtggt

SEQ ID NO: 2081 - DNA, 70 bp, Artificial Sequence
  Description of Artificial Sequence: Synthetic probe
aaagttacgcacccaattggcttcagcttcccgatatccgacggtagtgtgtgatgtaagccatccgatg

SEQ ID NO: 2082 - DNA, 70 bp, Artificial Sequence
  Description of Artificial Sequence: Synthetic probe
ccttcggggttcagggccttcagcttcccgatatccgacggtagtgtggagatgataggcctggtatgga

SEQ ID NO: 2083 - DNA, 70 bp, Artificial Sequence
  Description of Artificial Sequence: Synthetic probe
agtcggtccagccgaccacatcttcagcttcccgatatccgacggtagtgtgtgcccgccctccactcac

SEQ ID NO: 2084 - DNA, 70 bp, Artificial Sequence
  Description of Artificial Sequence: Synthetic probe
caggaggttctagggtaaggacttcagcttcccgatatccgacggtagtgttggccaaggtggtagaaca

SEQ ID NO: 2085 - DNA, 70 bp, Artificial Sequence
  Description of Artificial Sequence: Synthetic probe
ggcaaagagacaaaggccttcagcttcccgatatccgacggtagtgtggctgtttgtaaaacgtgtcctt

SEQ ID NO: 2086 - DNA, 70 bp, Artificial Sequence
  Description of Artificial Sequence: Synthetic probe
gggggtccccagagacttcagcttcccgatatccgacggtagtgtggtgatgtctacaatgatgggactg

SEQ ID NO: 2087 - DNA, 70 bp, Artificial Sequence
  Description of Artificial Sequence: Synthetic probe
gggtcacatgtgggagacttcagcttcccgatatccgacggtagtgtgacaaagttacgcacccaattgg

SEQ ID NO: 2088 - DNA, 70 bp, Artificial Sequence
  Description of Artificial Sequence: Synthetic probe
ttcatccacgttcaccttgccttcagcttcccgatatccgacggtagtgtagggtgggaaaatagaccaa

SEQ ID NO: 2089 - DNA, 70 bp, Artificial Sequence
  Description of Artificial Sequence: Synthetic probe
agggcagtaacggcacttcagcttcccgatatccgacggtagtgttaggcagagagagtcagtgcctatc

SEQ ID NO: 2090 - DNA, 70 bp, Artificial Sequence
  Description of Artificial Sequence: Synthetic probe
caggagtcagatgcacttcagcttcccgatatccgacggtagtgtagaaacccaagagtcttctctgtct

SEQ ID NO: 2091 - DNA, 70 bp, Artificial Sequence
  Description of Artificial Sequence: Synthetic probe
tgtttgaggttgctagtgaacttcagcttcccgatatccgacggtagtgttgcccagtttctattggtct

SEQ ID NO: 2092 - DNA, 70 bp, Artificial Sequence
  Description of Artificial Sequence: Synthetic probe
ttgtgtcagaagcaaatgcttcagcttcccgatatccgacggtagtgttaaacctgtcttgtaaccttga

SEQ ID NO: 2093 - DNA, 70 bp, Artificial Sequence
  Description of Artificial Sequence: Synthetic probe
tagatggctctgccctgactttcttcagcttcccgatatccgacggtagtgtctgcccagggcctcacca

SEQ ID NO: 2094 - DNA, 70 bp, Artificial Sequence
  Description of Artificial Sequence: Synthetic probe
gcccagccctggctcctgccctccttcagcttcccgatatccgacggtagtgtatccacgttcaccttgc

SEQ ID NO: 2095 - DNA, 70 bp, Artificial Sequence
  Description of Artificial Sequence: Synthetic probe
tgctcctgggagtagattggccaacttcagcttcccgatatccgacggtagtgtcagtaacggcagactt

SEQ ID NO: 2096 - DNA, 70 bp, Artificial Sequence
  Description of Artificial Sequence: Synthetic probe
gaagttctcaggatccaccttcagcttcccgatatccgacggtagtgtctaaaacgatcctgagacttcc

SEQ ID NO: 2097 - DNA, 70 bp, Artificial Sequence
  Description of Artificial Sequence: Synthetic probe
ttgtcacagtgcagccttcagcttcccgatatccgacggtagtgtacactgatgcaatcattcgtctgtt

SEQ ID NO: 2098 - DNA, 70 bp, Artificial Sequence; identical to SEQ ID NO: 1565
  Description of Artificial Sequence: Synthetic probe

SEQ ID NO: 2099 - DNA, 70 bp, Artificial Sequence; identical to SEQ ID NO: 1566
  Description of Artificial Sequence: Synthetic probe

SEQ ID NO: 2100 - DNA, 70 bp, Artificial Sequence; identical to SEQ ID NO: 1567
  Description of Artificial Sequence: Synthetic probe

SEQ ID NO: 2101 - DNA, 70 bp, Artificial Sequence; identical to SEQ ID NO: 1568
  Description of Artificial Sequence: Synthetic probe

SEQ ID NO: 2102 - DNA, 70 bp, Artificial Sequence
  Description of Artificial Sequence: Synthetic probe
tggcaaaggtgccctcttcagcttcccgatatccgacggtagtgttcccattctaaactgtaccctgtta

SEQ ID NO: 2103 - DNA, 70 bp, Artificial Sequence
  Description of Artificial Sequence: Synthetic probe
caggtgagccaggccacttcagcttcccgatatccgacggtagtgtttatccccttcctatgacatgaac

SEQ ID NO: 2104 - DNA, 70 bp, Artificial Sequence
  Description of Artificial Sequence: Synthetic probe
gcaccgagcactttccttcagcttcccgatatccgacggtagtgtttaaccatagaaaagaaggggaaag

SEQ ID NO: 2105 - DNA, 70 bp, Artificial Sequence
  Description of Artificial Sequence: Synthetic probe
ccttcaccttagggtcttcagcttcccgatatccgacggtagtgtaaaacatcaagcgtcccatagactc

SEQ ID NO: 2106 - DNA, 70 bp, Artificial Sequence
  Description of Artificial Sequence: Synthetic probe
agcatcaggagtggacagatccccacttcagcttcccgatatccgacggtagtgttctcaggatccacgt

SEQ ID NO: 2107 - DNA, 70 bp, Artificial Sequence
  Description of Artificial Sequence: Synthetic probe
aaggactcaaagaacctctgggtcccttcagcttcccgatatccgacggtagtgtacagtgcagctcact

SEQ ID NO: 2108 - DNA, 70 bp, Artificial Sequence; identical to SEQ ID NO: 1563
  Description of Artificial Sequence: Synthetic probe

SEQ ID NO: 2109 - DNA, 70 bp, Artificial Sequence; identical to SEQ ID NO: 1564
  Description of Artificial Sequence: Synthetic probe

SEQ ID NO: 2110 - DNA, 70 bp, Artificial Sequence
  Description of Artificial Sequence: Synthetic probe
acttgtgggccagggcttcagcttcccgatatccgacggtagtgttttaaatacatcattgcaatgaaaa

SEQ ID NO: 2111 - DNA, 70 bp, Artificial Sequence
  Description of Artificial Sequence: Synthetic probe
accagccaccactttcttcagcttcccgatatccgacggtagtgttaaatgttttttattaggcagaatc

SEQ ID NO: 2112 - DNA, 70 bp, Artificial Sequence
  Description of Artificial Sequence: Synthetic probe
gcctgcactggtgggcttcagcttcccgatatccgacggtagtgtcagatgctcaaggcccttcataata

SEQ ID NO: 2113 - DNA, 70 bp, Artificial Sequence
  Description of Artificial Sequence: Synthetic probe
tgccaaagtgatgggcttcagcttcccgatatccgacggtagtgttcccccagtttagtagttggactta

SEQ ID NO: 2114 - DNA, 70 bp, Artificial Sequence
  Description of Artificial Sequence: Synthetic probe
gaccagcacgttgcccttcagcttcccgatatccgacggtagtgtgggaacaaaggaacctttaatagaa

SEQ ID NO: 2115 - DNA, 70 bp, Artificial Sequence
  Description of Artificial Sequence: Synthetic probe
gggaggaagataagaggtcttcagcttcccgatatccgacggtagtgtggacagcaagaaagcgagctta

SEQ ID NO: 2116 - DNA, 70 bp, Artificial Sequence
  Description of Artificial Sequence: Synthetic probe
tgattagcaaaagggcctagcttggcttcagcttcccgatatccgacggtagtgttgggccagggcatta

SEQ ID NO: 2117 - DNA, 70 bp, Artificial Sequence
  Description of Artificial Sequence: Synthetic probe
actcagaataatccagccttatccccttcagcttcccgatatccgacggtagtgtccaccactttctgat

SEQ ID NO: 2118 - DNA, 70 bp, Artificial Sequence
  Description of Artificial Sequence: Synthetic probe
aaccataaaataaaagcagaatggtcttcagcttcccgatatccgacggtagtgtcactggtggggtgaa

SEQ ID NO: 2119 - DNA, 70 bp, Artificial Sequence
  Description of Artificial Sequence: Synthetic probe
agctggattgtagctgctattagcttcagcttcccgatatccgacggtagtgtcaaagtgatgggccagc

SEQ ID NO: 2120 - DNA, 70 bp, Artificial Sequence
  Description of Artificial Sequence: Synthetic probe
caagacccggaaccgaaaagccttcagcttcccgatatccgacggtagtgtgaggaagtggagtgcctgt

SEQ ID NO: 2121 - DNA, 70 bp, Artificial Sequence
  Description of Artificial Sequence: Synthetic probe
cacgatagcgctggaaggccttcagcttcccgatatccgacggtagtgtagagggctggacaaaagccca

SEQ ID NO: 2122 - DNA, 70 bp, Artificial Sequence
  Description of Artificial Sequence: Synthetic probe
tctcggagggggctggcttcagcttcccgatatccgacggtagtgtaattgaaagttgttcgggtaaagg

SEQ ID NO: 2123 - DNA, 70 bp, Artificial Sequence
  Description of Artificial Sequence: Synthetic probe
accctggtcaggtgagcgcttcagcttcccgatatccgacggtagtgttagcgctggtcggaggtttgga

SEQ ID NO: 2124 - DNA, 70 bp, Artificial Sequence
  Description of Artificial Sequence: Synthetic probe
cgtgacttatcggcgaatcacgtcttcagcttcccgatatccgacggtagtgtggccagggccagagggc

SEQ ID NO: 2125 - DNA, 70 bp, Artificial Sequence
  Description of Artificial Sequence: Synthetic probe
ccagaggcggctctgcgcctgcttcagcttcccgatatccgacggtagtgtccgtcctgcgaacgctgcc

SEQ ID NO: 2126 - DNA, 70 bp, Artificial Sequence
  Description of Artificial Sequence: Synthetic probe
cccaggaggacccacacccttcagcttcccgatatccgacggtagtgtagcagcagcgaaaaccaaagcc

SEQ ID NO: 2127 - DNA, 70 bp, Artificial Sequence
  Description of Artificial Sequence: Synthetic probe
gaggactgagcagccgggctcttcagcttcccgatatccgacggtagtgtcgtctctggagccctggggg

SEQ ID NO: 2128 - DNA, 70 bp, Artificial Sequence
  Description of Artificial Sequence: Synthetic probe
gccgagctgacatcgtactgcttcagcttcccgatatccgacggtagtgttccccaggcaggcactctca

SEQ ID NO: 2129 - DNA, 70 bp, Artificial Sequence
  Description of Artificial Sequence: Synthetic probe
gaaagttgttcgggtaaaggaccttcagcttcccgatatccgacggtagtgtggaacagggcgggacaag

SEQ ID NO: 2130 - DNA, 70 bp, Artificial Sequence
  Description of Artificial Sequence: Synthetic probe
gcgctggtcggaggttcttcagcttcccgatatccgacggtagtgtccgactcacctgtgaggtaaggac

SEQ ID NO: 2131 - DNA, 70 bp, Artificial Sequence
  Description of Artificial Sequence: Synthetic probe
tgaggccagggccagagcttcagcttcccgatatccgacggtagtgtggccaagacccggaaccgaaaag

SEQ ID NO: 2132 - DNA, 70 bp, Artificial Sequence
  Description of Artificial Sequence: Synthetic probe
cccgtcctgcgaacgctgcttcagcttcccgatatccgacggtagtgtgtcacgatagcgctggaaggcc

SEQ ID NO: 2133 - DNA, 70 bp, Artificial Sequence
  Description of Artificial Sequence: Synthetic probe
cagcagcgaaaaccaaagcctcttcagcttcccgatatccgacggtagtgtaggactgagcagccgggct

SEQ ID NO: 2134 - DNA, 70 bp, Artificial Sequence
  Description of Artificial Sequence: Synthetic probe
cttgtcatggcccgctggcttcagcttcccgatatccgacggtagtgtcggccgagctgacatcgtactg

SEQ ID NO: 2135 - DNA, 70 bp, Artificial Sequence
  Description of Artificial Sequence: Synthetic probe
tgccacaccacatagcccttcagcttcccgatatccgacggtagtgtggagagtgctccgaccattaaag

SEQ ID NO: 2136 - DNA, 70 bp, Artificial Sequence
  Description of Artificial Sequence: Synthetic probe
aagaagagacgatgtccagccttcagcttcccgatatccgacggtagtgttccaaaccaggaggatcagt

SEQ ID NO: 2137 - DNA, 70 bp, Artificial Sequence
  Description of Artificial Sequence: Synthetic probe
ggagaggagaggagtgtctagtcttcagcttcccgatatccgacggtagtgtgaggcagggaggagctgg

SEQ ID NO: 2138 - DNA, 70 bp, Artificial Sequence
  Description of Artificial Sequence: Synthetic probe
tgtctgcttagctcacttcagcttcccgatatccgacggtagtgtggagaccagagggaggcactgctgg

SEQ ID NO: 2139 - DNA, 70 bp, Artificial Sequence
  Description of Artificial Sequence: Synthetic probe
agactgtttgtgccagtgctcttcagcttcccgatatccgacggtagtgttcttctcttctctgccccgg

SEQ ID NO: 2140 - DNA, 70 bp, Artificial Sequence
  Description of Artificial Sequence: Synthetic probe
ggttgagcctggccacttcagcttcccgatatccgacggtagtgtctcacctttactttattatcaaaca

SEQ ID NO: 2141 - DNA, 70 bp, Artificial Sequence
  Description of Artificial Sequence: Synthetic probe
cctcattaagcagtgtctttccttcagcttcccgatatccgacggtagtgtgccacaccacatagccctt

SEQ ID NO: 2142 - DNA, 70 bp, Artificial Sequence
  Description of Artificial Sequence: Synthetic probe
gggctgaaaaccaaccactccttcagcttcccgatatccgacggtagtgtaagaagagacgatgtccagc

SEQ ID NO: 2143 - DNA, 70 bp, Artificial Sequence
  Description of Artificial Sequence: Synthetic probe
ttcaaatgccaggggttccacttcagcttcccgatatccgacggtagtgtccctctcaaccaccttccca

SEQ ID NO: 2144 - DNA, 70 bp, Artificial Sequence
  Description of Artificial Sequence: Synthetic probe
tagaaatccttccagtcagggcttcagcttcccgatatccgacggtagtgtccctcaccccagctaagtt

SEQ ID NO: 2145 - DNA, 70 bp, Artificial Sequence
  Description of Artificial Sequence: Synthetic probe
caggcaacatgggacaacacttcagcttcccgatatccgacggtagtgtggccttggtgaccagttccag

SEQ ID NO: 2146 - DNA, 70 bp, Artificial Sequence
  Description of Artificial Sequence: Synthetic probe
tgctccctctgttccccttcagcttcccgatatccgacggtagtgttccttcatatagttcactggaata

SEQ ID NO: 2147 - DNA, 70 bp, Artificial Sequence
  Description of Artificial Sequence: Synthetic probe
agtatgtctctgtgactcctcttcagcttcccgatatccgacggtagtgttcgccacacctgtatgattg

SEQ ID NO: 2148 - DNA, 70 bp, Artificial Sequence
  Description of Artificial Sequence: Synthetic probe
aggatatacggttcaggtcttcagcttcccgatatccgacggtagtgttcatttactaactggaaatgtc

SEQ ID NO: 2149 - DNA, 70 bp, Artificial Sequence
  Description of Artificial Sequence: Synthetic probe
ggcagagagaagggcccgcttcagcttcccgatatccgacggtagtgtcccagaccttcctgcctcccat

SEQ ID NO: 2150 - DNA, 70 bp, Artificial Sequence
  Description of Artificial Sequence: Synthetic probe
gccttggtgaccagttccagcttcagcttcccgatatccgacggtagtgtgccccaacccagcctccttt

SEQ ID NO: 2151 - DNA, 70 bp, Artificial Sequence
  Description of Artificial Sequence: Synthetic probe
tcatatagttcactggaatatcccttcagcttcccgatatccgacggtagtgtaggagagctctctgctt

SEQ ID NO: 2152 - DNA, 70 bp, Artificial Sequence
  Description of Artificial Sequence: Synthetic probe
tcgccacacctgtatgattgtcttcagcttcccgatatccgacggtagtgttcaaatgccaggggttcca

SEQ ID NO: 2153 - DNA, 70 bp, Artificial Sequence
  Description of Artificial Sequence: Synthetic probe
ggctgaatctgttataaaaggcttcagcttcccgatatccgacggtagtgtagaaatccttccagtcagg

SEQ ID NO: 2154 - DNA, 70 bp, Artificial Sequence
  Description of Artificial Sequence: Synthetic probe
atggcagtaaggacacaaagcttcagcttcccgatatccgacggtagtgtaggatatacggttcaggtac

SEQ ID NO: 2155 - DNA, 70 bp, Artificial Sequence
  Description of Artificial Sequence: Synthetic probe
gagattcctgggccttattcacttcagcttcccgatatccgacggtagtgtgcagagagaagggcccgga

SEQ ID NO: 2156 - DNA, 70 bp, Artificial Sequence
  Description of Artificial Sequence: Synthetic probe
gtgttgtccacatattctcccccttcagcttcccgatatccgacggtagtgtacggcctgctctctctca

SEQ ID NO: 2157 - DNA, 70 bp, Artificial Sequence
  Description of Artificial Sequence: Synthetic probe
tacaagcctctccaccacttcagcttcccgatatccgacggtagtgtcctgaaagaagggtactagtcca

SEQ ID NO: 2158 - DNA, 70 bp, Artificial Sequence
  Description of Artificial Sequence: Synthetic probe
agccttctgctcaggggcttcagcttcccgatatccgacggtagtgtggtggctagatgggattgggtct

SEQ ID NO: 2159 - DNA, 70 bp, Artificial Sequence
  Description of Artificial Sequence: Synthetic probe
ggaaaacaagcaacaacagtcttcagcttcccgatatccgacggtagtgtggagaactcctgctctcagg

SEQ ID NO: 2160 - DNA, 70 bp, Artificial Sequence
  Description of Artificial Sequence: Synthetic probe
gatggtggggtaactcttcagcttcccgatatccgacggtagtgtcccaaccctccacctcccccccgaa

SEQ ID NO: 2161 - DNA, 70 bp, Artificial Sequence
  Description of Artificial Sequence: Synthetic probe
tctcaaccaccttcccaatgtgcttcagcttcccgatatccgacggtagtgtaccagagcctggggacca

SEQ ID NO: 2162 - DNA, 70 bp, Artificial Sequence
  Description of Artificial Sequence: Synthetic probe
ctcaccccagctaagttgtcttcagcttcccgatatccgacggtagtgttgtgttgtccacatattctcc

SEQ ID NO: 2163 - DNA, 70 bp, Artificial Sequence
  Description of Artificial Sequence: Synthetic probe
tactaactggaaatgtctggccttcagcttcccgatatccgacggtagtgtacaagcctctccaccaatc

SEQ ID NO: 2164 - DNA, 70 bp, Artificial Sequence
  Description of Artificial Sequence: Synthetic probe
gaagtgtgacaaacgttcatcttcagcttcccgatatccgacggtagtgttccgtggatgagggctgact

SEQ ID NO: 2165 - DNA, 70 bp, Artificial Sequence
  Description of Artificial Sequence: Synthetic probe
aatgtcaggtcagatgtcacttcagcttcccgatatccgacggtagtgtgcctctgtaagtgttagctat

SEQ ID NO: 2166 - DNA, 70 bp, Artificial Sequence
  Description of Artificial Sequence: Synthetic probe
tgctccacagcctttcggcaacagccttcagcttcccgatatccgacggtagtgttgtcttcctctctct

SEQ ID NO: 2167 - DNA, 70 bp, Artificial Sequence
  Description of Artificial Sequence: Synthetic probe
ccctgctctgggcctggacttcagcttcccgatatccgacggtagtgtgggttccccagccctggatctg

SEQ ID NO: 2168 - DNA, 70 bp, Artificial Sequence
  Description of Artificial Sequence: Synthetic probe
gggcatgtgccagattgggccttcagcttcccgatatccgacggtagtgtctccgccttgcgaaggcccc

SEQ ID NO: 2169 - DNA, 70 bp, Artificial Sequence
  Description of Artificial Sequence: Synthetic probe
attccctgcaaaggtgctcttcagcttcccgatatccgacggtagtgtgcttgcttacctcagcaattca

SEQ ID NO: 2170 - DNA, 70 bp, Artificial Sequence
  Description of Artificial Sequence: Synthetic probe
cacaggctgctacctcttgtcttcagcttcccgatatccgacggtagtgtgaagtgtgacaaacgttcat

SEQ ID NO: 2171 - DNA, 70 bp, Artificial Sequence
  Description of Artificial Sequence: Synthetic probe
caccctggactcactcacttcagcttcccgatatccgacggtagtgtgcaaatgtcaggtcagatgtcaa

SEQ ID NO: 2172 - DNA, 70 bp, Artificial Sequence
  Description of Artificial Sequence: Synthetic probe
gaagtgatcaataccttgttatgcttcagcttcccgatatccgacggtagtgttccacagcctttcggca

SEQ ID NO: 2173 - DNA, 70 bp, Artificial Sequence
  Description of Artificial Sequence: Synthetic probe
caggtctgttcaaactcctgctcttcagcttcccgatatccgacggtagtgtccagcaccggcccctttc

SEQ ID NO: 2174 - DNA, 70 bp, Artificial Sequence
  Description of Artificial Sequence: Synthetic probe
agaagcctacattgaggggttggcttcagcttcccgatatccgacggtagtgtcacaggggcacgcaggc

SEQ ID NO: 2175 - DNA, 70 bp, Artificial Sequence
  Description of Artificial Sequence: Synthetic probe
ctggacacctcgcctgcaagcttcagcttcccgatatccgacggtagtgtgcacgaaggcaaggggctcc

SEQ ID NO: 2176 - DNA, 70 bp, Artificial Sequence
  Description of Artificial Sequence: Synthetic probe
atgaagaaatggcaagataagccttcagcttcccgatatccgacggtagtgtggccaggatgcagtggaa

SEQ ID NO: 2177 - DNA, 70 bp, Artificial Sequence
  Description of Artificial Sequence: Synthetic probe
tcagaaggggccccagccttcagcttcccgatatccgacggtagtgtctggctccactaccattcaccta

SEQ ID NO: 2178 - DNA, 70 bp, Artificial Sequence
  Description of Artificial Sequence: Synthetic probe
tcacaccagtcaacagtctctcttcagcttcccgatatccgacggtagtgtgcaccctcctcggtgcctg

SEQ ID NO: 2179 - DNA, 70 bp, Artificial Sequence
  Description of Artificial Sequence: Synthetic probe
ccccatttcggtgactccttcagcttcccgatatccgacggtagtgtgctcaggtctgttcaaactcctg

SEQ ID NO: 2180 - DNA, 70 bp, Artificial Sequence
  Description of Artificial Sequence: Synthetic probe
tcactgtacaccaaatgcaccttcagcttcccgatatccgacggtagtgtagaagcctacattgaggggt

SEQ ID NO: 2181 - DNA, 70 bp, Artificial Sequence
  Description of Artificial Sequence: Synthetic probe
gtaggaagctggttacatccaggcttcagcttcccgatatccgacggtagtgttgaccctcggtccccag

SEQ ID NO: 2182 - DNA, 70 bp, Artificial Sequence
  Description of Artificial Sequence: Synthetic probe
tgactacagagacaaccaacacacttcagcttcccgatatccgacggtagtgtgggactccaggccgagc

SEQ ID NO: 2183 - DNA, 70 bp, Artificial Sequence
  Description of Artificial Sequence: Synthetic probe
cttctccagtgtatgccgtcttcagcttcccgatatccgacggtagtgtgcagtttaggccaggccatcc

SEQ ID NO: 2184 - DNA, 70 bp, Artificial Sequence
  Description of Artificial Sequence: Synthetic probe
aggaagacagggtaagcttggcttcagcttcccgatatccgacggtagtgtacagcttcagacaagtgtt

SEQ ID NO: 2185 - DNA, 70 bp, Artificial Sequence
  Description of Artificial Sequence: Synthetic probe
gccaacctgccattagaacttcagcttcccgatatccgacggtagtgttcttctaagacagggaacagga

SEQ ID NO: 2186 - DNA, 70 bp, Artificial Sequence
  Description of Artificial Sequence: Synthetic probe
gcaaaaccaagaccctagccttcagcttcccgatatccgacggtagtgtacttacaattctccactgact

SEQ ID NO: 2187 - DNA, 70 bp, Artificial Sequence
  Description of Artificial Sequence: Synthetic probe
ccctcagctcacacgcctgtcttcagcttcccgatatccgacggtagtgtgtaggaagctggttacatcc

SEQ ID NO: 2188 - DNA, 70 bp, Artificial Sequence
  Description of Artificial Sequence: Synthetic probe
aggaaagggaggacatggccttcagcttcccgatatccgacggtagtgtgtgactacagagacaaccaac

SEQ ID NO: 2189 - DNA, 70 bp, Artificial Sequence
  Description of Artificial Sequence: Synthetic probe
ccttggcataggcagtgcccttcagcttcccgatatccgacggtagtgttcttctccagtgtatgccgtt

SEQ ID NO: 2190 - DNA, 70 bp, Artificial Sequence
  Description of Artificial Sequence: Synthetic probe
tccccagacagtctcagagcttcagcttcccgatatccgacggtagtgttgggaggctaaagagggaaga

SEQ ID NO: 2191 - DNA, 70 bp, Artificial Sequence
  Description of Artificial Sequence: Synthetic probe
aaacactggtcatcatttatggcttcagcttcccgatatccgacggtagtgtagcctaggaggcagaggt

SEQ ID NO: 2192 - DNA, 70 bp, Artificial Sequence
  Description of Artificial Sequence: Synthetic probe
gggtatctgaaatgacagaaatgcttcagcttcccgatatccgacggtagtgtgcagggactgggccact

SEQ ID NO: 2193 - DNA, 70 bp, Artificial Sequence
  Description of Artificial Sequence: Synthetic probe
ctcatttagttggttaaggtcttcagcttcccgatatccgacggtagtgtccaccaacaccaaccttccc

SEQ ID NO: 2194 - DNA, 70 bp, Artificial Sequence
  Description of Artificial Sequence: Synthetic probe
attctcagattatagaccagacttcagcttcccgatatccgacggtagtgttcctttctctctctctttt

SEQ ID NO: 2195 - DNA, 70 bp, Artificial Sequence
  Description of Artificial Sequence: Synthetic probe
ctatataaatcactggactcttcagcttcccgatatccgacggtagtgtagccccaatttgttacctcgg

SEQ ID NO: 2196 - DNA, 70 bp, Artificial Sequence
  Description of Artificial Sequence: Synthetic probe
aaaaaacagtaagaccatatcttcagcttcccgatatccgacggtagtgttccccagacagtctcagaga

SEQ ID NO: 2197 - DNA, 70 bp, Artificial Sequence
  Description of Artificial Sequence: Synthetic probe
aaaaaatctttcaatgaggagcttcagcttcccgatatccgacggtagtgtaacactggtcatcatttat

SEQ ID NO: 2198 - DNA, 70 bp, Artificial Sequence
  Description of Artificial Sequence: Synthetic probe
gtgccctcagcagatttcccttcagcttcccgatatccgacggtagtgtgttttccactcacatctcctc

SEQ ID NO: 2199 - DNA, 70 bp, Artificial Sequence
  Description of Artificial Sequence: Synthetic probe
gctggctaaaagtctccagacttcagcttcccgatatccgacggtagtgttttctactggggctatctca

SEQ ID NO: 2200 - DNA, 70 bp, Artificial Sequence
  Description of Artificial Sequence: Synthetic probe
gaagatgtagagaggcagacttcagcttcccgatatccgacggtagtgtaccaggatcctaaggcaaaac

SEQ ID NO: 2201 - DNA, 70 bp, Artificial Sequence
  Description of Artificial Sequence: Synthetic probe
actcagggagtggaaacttcagcttcccgatatccgacggtagtgtagatttttctaggattctcaatat

SEQ ID NO: 2202 - DNA, 70 bp, Artificial Sequence
  Description of Artificial Sequence: Synthetic probe
ctctatttggaaggttctcacttcagcttcccgatatccgacggtagtgttccaaccccagagatgaaaa

SEQ ID NO: 2203 - DNA, 70 bp, Artificial Sequence
  Description of Artificial Sequence: Synthetic probe
gcagagcataacatttgggcttcagcttcccgatatccgacggtagtgtgccctttttgagggtccacac

SEQ ID NO: 2204 - DNA, 70 bp, Artificial Sequence
  Description of Artificial Sequence: Synthetic probe
gggaaaatggatgtagtgtaggcttcagcttcccgatatccgacggtagtgtgccctcagcagatttcca

SEQ ID NO: 2205 - DNA, 70 bp, Artificial Sequence
  Description of Artificial Sequence: Synthetic probe
tgctagagagtggcaggtcttcagcttcccgatatccgacggtagtgtttgggattacaggcatgagcca

SEQ ID NO: 2206 - DNA, 70 bp, Artificial Sequence
  Description of Artificial Sequence: Synthetic probe
agatgtatccaacagcaagccttcagcttcccgatatccgacggtagtgtcccagtccatacattccctc

SEQ ID NO: 2207 - DNA, 70 bp, Artificial Sequence
  Description of Artificial Sequence: Synthetic probe
tgaggaaagcggggacttcagcttcccgatatccgacggtagtgttctaactctttaagaatttggaact

SEQ ID NO: 2208 - DNA, 70 bp, Artificial Sequence
  Description of Artificial Sequence: Synthetic probe
tctcagtcttgttgataaagaactgcttcagcttcccgatatccgacggtagtgtgttgctccatcaccc

SEQ ID NO: 2209 - DNA, 70 bp, Artificial Sequence
  Description of Artificial Sequence: Synthetic probe
tgcagaacaaacattgaaccttcagcttcccgatatccgacggtagtgtactcttaagtgtgaagaaggc

SEQ ID NO: 2210 - DNA, 70 bp, Artificial Sequence
  Description of Artificial Sequence: Synthetic probe
gtttcaaaggaagcttactcttcagcttcccgatatccgacggtagtgtaggcctggttaccagagtgtc

SEQ ID NO: 2211 - DNA, 70 bp, Artificial Sequence
  Description of Artificial Sequence: Synthetic probe
gcacagggagatgaagacaacttcagcttcccgatatccgacggtagtgttgctagagagtggcaggtaa

SEQ ID NO: 2212 - DNA, 70 bp, Artificial Sequence
  Description of Artificial Sequence: Synthetic probe
ccaggattcttaaaaagccacttcagcttcccgatatccgacggtagtgtagatgtatccaacagcaagc

SEQ ID NO: 2213 - DNA, 70 bp, Artificial Sequence
  Description of Artificial Sequence: Synthetic probe
tgactgttctcagggtcgccttcagcttcccgatatccgacggtagtgtgtgaggaaagcggggaaagtc

SEQ ID NO: 2214 - DNA, 70 bp, Artificial Sequence
  Description of Artificial Sequence: Synthetic probe
cctaaatgctccccacccttcagcttcccgatatccgacggtagtgtcaatctcagtcttgttgataaag

SEQ ID NO: 2215 - DNA, 70 bp, Artificial Sequence
  Description of Artificial Sequence: Synthetic probe
tttctcatgagctctggaacttcagcttcccgatatccgacggtagtgttcaagtctcctgactccaaat

SEQ ID NO: 2216 - DNA, 70 bp, Artificial Sequence
  Description of Artificial Sequence: Synthetic probe
agctctcatatgggaaggacttcagcttcccgatatccgacggtagtgttgtccttcccctatattggtc

SEQ ID NO: 2217 - DNA, 70 bp, Artificial Sequence
  Description of Artificial Sequence: Synthetic probe
atctaccagatgccagtggcttcagcttcccgatatccgacggtagtgtactggctggttaggatgagag

SEQ ID NO: 2218 - DNA, 70 bp, Artificial Sequence
  Description of Artificial Sequence: Synthetic probe
ttcaatttattgtacgccatgacacttcagcttcccgatatccgacggtagtgtttgccagcagggccac

SEQ ID NO: 2219 - DNA, 70 bp, Artificial Sequence
  Description of Artificial Sequence: Synthetic probe
cctgtaggttaaagtgcaccttcagcttcccgatatccgacggtagtgtagattcagacattgacccata

SEQ ID NO: 2220 - DNA, 70 bp, Artificial Sequence
  Description of Artificial Sequence: Synthetic probe
aacccatcacagtctctccgcttcagcttcccgatatccgacggtagtgtggtctgagtgaaacgggaac

SEQ ID NO: 2221 - DNA, 70 bp, Artificial Sequence
  Description of Artificial Sequence: Synthetic probe
agcctcaaacttgcgatgcttcagcttcccgatatccgacggtagtgtcctttctcatgagctctggaaa

SEQ ID NO: 2222 - DNA, 70 bp, Artificial Sequence
  Description of Artificial Sequence: Synthetic probe
agctctcaggccgctcttcagcttcccgatatccgacggtagtgtagtgaagctctcatatgggaaggaa

SEQ ID NO: 2223 - DNA, 70 bp, Artificial Sequence
  Description of Artificial Sequence: Synthetic probe
ctacaggcttgacctgcccttcagcttcccgatatccgacggtagtgttcatctaccagatgccagtgga

SEQ ID NO: 2224 - DNA, 70 bp, Artificial Sequence
  Description of Artificial Sequence: Synthetic probe
tcaattaagtatttatggggtcttcagcttcccgatatccgacggtagtgttcaatttattgtacgccat

SEQ ID NO: 2225 - DNA, 70 bp, Artificial Sequence
  Description of Artificial Sequence: Synthetic probe
tggtccccaggacaaagtgcttcagcttcccgatatccgacggtagtgttcctatctaaattcccaggtg

SEQ ID NO: 2226 - DNA, 70 bp, Artificial Sequence
  Description of Artificial Sequence: Synthetic probe
ggagtgtcaaactctgcacttcagcttcccgatatccgacggtagtgtgaagtcgatggaaaacattctt

SEQ ID NO: 2227 - DNA, 70 bp, Artificial Sequence
  Description of Artificial Sequence: Synthetic probe
gtcagggactatcttcaaacttcagcttcccgatatccgacggtagtgttgtgtagatgtgggtgacagg

SEQ ID NO: 2228 - DNA, 70 bp, Artificial Sequence
  Description of Artificial Sequence: Synthetic probe
ggataccccggagccgtgcttcagcttcccgatatccgacggtagtgtaggaccaaggctgggatatgcc

SEQ ID NO: 2229 - DNA, 70 bp, Artificial Sequence
  Description of Artificial Sequence: Synthetic probe
aatgacctccttcacatcctgtcttcagcttcccgatatccgacggtagtgttgagccagtgccctgaag

SEQ ID NO: 2230 - DNA, 70 bp, Artificial Sequence
  Description of Artificial Sequence: Synthetic probe
gtgtagatgtgggtgacagcttcagcttcccgatatccgacggtagtgtactctgagcataacaagcaga

SEQ ID NO: 2231 - DNA, 70 bp, Artificial Sequence
  Description of Artificial Sequence: Synthetic probe
aggacccctgaaaggcacttcagcttcccgatatccgacggtagtgtccctctggtcccagacatcattc

SEQ ID NO: 2232 - DNA, 70 bp, Artificial Sequence
  Description of Artificial Sequence: Synthetic probe
ccttcaggttcacacttcctcttcagcttcccgatatccgacggtagtgttggtccccaggacaaagtgt

SEQ ID NO: 2233 - DNA, 70 bp, Artificial Sequence
  Description of Artificial Sequence: Synthetic probe
ctagcagagtagaagatactcttcagcttcccgatatccgacggtagtgtggagtgtcaaactctgcaag

SEQ ID NO: 2234 - DNA, 70 bp, Artificial Sequence
  Description of Artificial Sequence: Synthetic probe
tgcccacaagactccccagatacttcagcttcccgatatccgacggtagtgtataccccggagccgtgcg

SEQ ID NO: 2235 - DNA, 70 bp, Artificial Sequence
  Description of Artificial Sequence: Synthetic probe
gaaaacctgcccatagccccttcagcttcccgatatccgacggtagtgtcaatgacctccttcacatcct

SEQ ID NO: 2236 - DNA, 70 bp, Artificial Sequence
  Description of Artificial Sequence: Synthetic probe
aatcaacctcatctcctccacttcagcttcccgatatccgacggtagtgtggaaggcctaagacctgagc

SEQ ID NO: 2237 - DNA, 70 bp, Artificial Sequence
  Description of Artificial Sequence: Synthetic probe
aagataaaaatctgggaagacacttcagcttcccgatatccgacggtagtgtgcccatacagacccctga

SEQ ID NO: 2238 - DNA, 70 bp, Artificial Sequence
  Description of Artificial Sequence: Synthetic probe
cacacaaagcaagacaagtgcttcagcttcccgatatccgacggtagtgtgggattcactggtccaaagg

SEQ ID NO: 2239 - DNA, 70 bp, Artificial Sequence
  Description of Artificial Sequence: Synthetic probe
ataaacatcacacacatttaggcttcagcttcccgatatccgacggtagtgtgggctcagacccagagta

SEQ ID NO: 2240 - DNA, 70 bp, Artificial Sequence
  Description of Artificial Sequence: Synthetic probe
ctgacttctaagaagaatgtgccttcagcttcccgatatccgacggtagtgtagctgagctaagcagccc

SEQ ID NO: 2241 - DNA, 70 bp, Artificial Sequence
  Description of Artificial Sequence: Synthetic probe
tgaactcataggtattatcttcagcttcccgatatccgacggtagtgtgggtgctaacttctattctgag

SEQ ID NO: 2242 - DNA, 70 bp, Artificial Sequence
  Description of Artificial Sequence: Synthetic probe
gggattcactggtccaaaggtcttcagcttcccgatatccgacggtagtgtactgatcaggccacagtgg

SEQ ID NO: 2243 - DNA, 70 bp, Artificial Sequence
  Description of Artificial Sequence: Synthetic probe
gagggctcagacccagacttcagcttcccgatatccgacggtagtgtagatcaaagggctcataccagca

SEQ ID NO: 2244 - DNA, 70 bp, Artificial Sequence
  Description of Artificial Sequence: Synthetic probe
gagtcagtaatccagggatacctaacttcagcttcccgatatccgacggtagtgtacctcatctcctcca

SEQ ID NO: 2245 - DNA, 70 bp, Artificial Sequence
  Description of Artificial Sequence: Synthetic probe
gccaagagaaaaccccacttcagcttcccgatatccgacggtagtgtatgaagataaaaatctgggaaga

SEQ ID NO: 2246 - DNA, 70 bp, Artificial Sequence
  Description of Artificial Sequence: Synthetic probe
tcacaaatacataaaccccttcagcttcccgatatccgacggtagtgtagctgacttctaagaagaatgt

SEQ ID NO: 2247 - DNA, 70 bp, Artificial Sequence
  Description of Artificial Sequence: Synthetic probe
cagtcctacacgtaaggcttcagcttcccgatatccgacggtagtgttcatgaactcataggtattattg

SEQ ID NO: 2248 - DNA, 70 bp, Artificial Sequence
  Description of Artificial Sequence: Synthetic probe
tctggatgtagaaggactcccttcagcttcccgatatccgacggtagtgtaccactccaaatctgaaagg

SEQ ID NO: 2249 - DNA, 70 bp, Artificial Sequence
  Description of Artificial Sequence: Synthetic probe
cttgaagtcctcaccgaagccttcagcttcccgatatccgacggtagtgtacaaaggacaagggaaccct

SEQ ID NO: 2250 - DNA, 70 bp, Artificial Sequence
  Description of Artificial Sequence: Synthetic probe
ttcctcataaagtcctggatctcttcagcttcccgatatccgacggtagtgtccagacagtggccaagca

SEQ ID NO: 2251 - DNA, 70 bp, Artificial Sequence
  Description of Artificial Sequence: Synthetic probe
ggttggacttcctgaatccccttcagcttcccgatatccgacggtagtgttgactcggtatggaaaggga

SEQ ID NO: 2252 - DNA, 70 bp, Artificial Sequence
  Description of Artificial Sequence: Synthetic probe
aaaatgaagattaatctttcaacacttcagcttcccgatatccgacggtagtgtaggaggacccccaagg

SEQ ID NO: 2253 - DNA, 70 bp, Artificial Sequence
  Description of Artificial Sequence: Synthetic probe
cctgaaagcctaatgcctgggcttcagcttcccgatatccgacggtagtgtacccaccctccttccttcc

SEQ ID NO: 2254 - DNA, 70 bp, Artificial Sequence
  Description of Artificial Sequence: Synthetic probe
agtcacctggccccctcttcagcttcccgatatccgacggtagtgtcacgtctggatgtagaaggactcc

SEQ ID NO: 2255 - DNA, 70 bp, Artificial Sequence
  Description of Artificial Sequence: Synthetic probe
tcttttcacctgaaaaatcaaacttcagcttcccgatatccgacggtagtgttgaagtcctcaccgaagc

SEQ ID NO: 2256 - DNA, 70 bp, Artificial Sequence
  Description of Artificial Sequence: Synthetic probe
gcaaggatctcagaagcccttcagcttcccgatatccgacggtagtgttcttcctcataaagtcctggat

SEQ ID NO: 2257 - DNA, 70 bp, Artificial Sequence
  Description of Artificial Sequence: Synthetic probe
tctcttgagacagggtctacttctacttcagcttcccgatatccgacggtagtgtggcatatatatgaag

SEQ ID NO: 2258 - DNA, 70 bp, Artificial Sequence
  Description of Artificial Sequence: Synthetic probe
tcaggccatgttctgaacccttcagcttcccgatatccgacggtagtgtagatgtttatttgggaggata

SEQ ID NO: 2259 - DNA, 70 bp, Artificial Sequence
  Description of Artificial Sequence: Synthetic probe
tttaaatgaaatgattcaggggcttcagcttcccgatatccgacggtagtgttgaatatccctgaactcc

SEQ ID NO: 2260 - DNA, 70 bp, Artificial Sequence
  Description of Artificial Sequence: Synthetic probe
aagaagtggtagtcagacttcagcttcccgatatccgacggtagtgtggtccgaaataatttcagatttc

SEQ ID NO: 2261 - DNA, 70 bp, Artificial Sequence
  Description of Artificial Sequence: Synthetic probe
caccgtcccctgttcacttcagcttcccgatatccgacggtagtgtaaattcaataagatataaagaaag

SEQ ID NO: 2262 - DNA, 70 bp, Artificial Sequence
  Description of Artificial Sequence: Synthetic probe
gagaagcactgaggattcccttcagcttcccgatatccgacggtagtgttgtggggaaagaaatttggaa

SEQ ID NO: 2263 - DNA, 70 bp, Artificial Sequence
  Description of Artificial Sequence: Synthetic probe
cttgaatatccctgaactccacttcagcttcccgatatccgacggtagtgtaaatcaagggtcataccca

SEQ ID NO: 2264 - DNA, 70 bp, Artificial Sequence
  Description of Artificial Sequence: Synthetic probe
ccgaaataatttcagatttcgcttcagcttcccgatatccgacggtagtgtggcattctacatcagtaac

SEQ ID NO: 2265 - DNA, 70 bp, Artificial Sequence
  Description of Artificial Sequence: Synthetic probe
atgaagtgattcccacgagacttcagcttcccgatatccgacggtagtgttctcttgagacagggtctac

SEQ ID NO: 2266 - DNA, 70 bp, Artificial Sequence
  Description of Artificial Sequence: Synthetic probe
acaactatcccttgatgaatcacttcagcttcccgatatccgacggtagtgtaggccatgttctgaacca

SEQ ID NO: 2267 - DNA, 70 bp, Artificial Sequence
  Description of Artificial Sequence: Synthetic probe
atctctaagagaaaaataaatcttcagcttcccgatatccgacggtagtgtaccgtcccctgttcagttc

SEQ ID NO: 2268 - DNA, 70 bp, Artificial Sequence
  Description of Artificial Sequence: Synthetic probe
taatagtgataaatgaccatcttcagcttcccgatatccgacggtagtgtgagaagcactgaggattccc

SEQ ID NO: 2269 - DNA, 70 bp, Artificial Sequence
  Description of Artificial Sequence: Synthetic probe
acaagtcacttgaattatctcccttcagcttcccgatatccgacggtagtgtaacaagtaacccaaacag

SEQ ID NO: 2270 - DNA, 70 bp, Artificial Sequence
  Description of Artificial Sequence: Synthetic probe
gctccggtcagtcgtcttcagcttcccgatatccgacggtagtgtccaaaacaaataaagattccccact

SEQ ID NO: 2271 - DNA, 70 bp, Artificial Sequence
  Description of Artificial Sequence: Synthetic probe
agacttcatcccacttgccacttcagcttcccgatatccgacggtagtgtggtcacagggtcccacatca

SEQ ID NO: 2272 - DNA, 70 bp, Artificial Sequence
  Description of Artificial Sequence: Synthetic probe
gttcaagggcaatcttttctcttcagcttcccgatatccgacggtagtgtacaatcttgctcttcccaca

SEQ ID NO: 2273 - DNA, 70 bp, Artificial Sequence
  Description of Artificial Sequence: Synthetic probe
aaaggacccttcctgctcacttcagcttcccgatatccgacggtagtgtctgaaggataaactttgcttg

SEQ ID NO: 2274 - DNA, 70 bp, Artificial Sequence
  Description of Artificial Sequence: Synthetic probe
tctctaaaataagaacaatcttcagcttcccgatatccgacggtagtgtaccagtgatagtttccaacag

SEQ ID NO: 2275 - DNA, 70 bp, Artificial Sequence
  Description of Artificial Sequence: Synthetic probe
tcataggcgaggtaatgccacttcagcttcccgatatccgacggtagtgtagtcaaaccaccacatctgc

SEQ ID NO: 2276 - DNA, 70 bp, Artificial Sequence
  Description of Artificial Sequence: Synthetic probe
gacagagaacatgcacttcagcttcccgatatccgacggtagtgtaggccctaggctcaggaccccttgc

SEQ ID NO: 2277 - DNA, 70 bp, Artificial Sequence
  Description of Artificial Sequence: Synthetic probe
ggtcacagggtcccacacttcagcttcccgatatccgacggtagtgtgctcatggacacacttcccagga

SEQ ID NO: 2278 - DNA, 70 bp, Artificial Sequence
  Description of Artificial Sequence: Synthetic probe
acaatcttgctcttcccaccttcagcttcccgatatccgacggtagtgtacttccatcaatgacagccac

SEQ ID NO: 2279 - DNA, 70 bp, Artificial Sequence
  Description of Artificial Sequence: Synthetic probe
tgaaggataaactttgctcttcagcttcccgatatccgacggtagtgtggacaagtcacttgaattatct

SEQ ID NO: 2280 - DNA, 70 bp, Artificial Sequence
  Description of Artificial Sequence: Synthetic probe
ccagtgatagtttccaacagtcccttcagcttcccgatatccgacggtagtgtccggtcagtcgtccagt

SEQ ID NO: 2281 - DNA, 70 bp, Artificial Sequence
  Description of Artificial Sequence: Synthetic probe
agctgaactgcaagggaaaacttcagcttcccgatatccgacggtagtgttcataggcgaggtaatgcca

SEQ ID NO: 2282 - DNA, 70 bp, Artificial Sequence
  Description of Artificial Sequence: Synthetic probe
agaaggccgttagaggctgcttcagcttcccgatatccgacggtagtgttgacagagaacatgcagccgg

SEQ ID NO: 2283 - DNA, 70 bp, Artificial Sequence
  Description of Artificial Sequence: Synthetic probe
atctggttactggcatctagaacacttcagcttcccgatatccgacggtagtgtgatatcaactgcagac

SEQ ID NO: 2284 - DNA, 70 bp, Artificial Sequence
  Description of Artificial Sequence: Synthetic probe
caaggtcattactcttttgaggcttcagcttcccgatatccgacggtagtgtttttgagaaacactagac

SEQ ID NO: 2285 - DNA, 70 bp, Artificial Sequence
  Description of Artificial Sequence: Synthetic probe
attcacaaaaaaataactttcaacttcagcttcccgatatccgacggtagtgtacatgggaggcggaacc

SEQ ID NO: 2286 - DNA, 70 bp, Artificial Sequence
  Description of Artificial Sequence: Synthetic probe
tttttctcaggaacaagtctcttcagcttcccgatatccgacggtagtgtctgccggaagactgtcacca

SEQ ID NO: 2287 - DNA, 70 bp, Artificial Sequence
  Description of Artificial Sequence: Synthetic probe
tgctaagaatgtgacttgacttcagcttcccgatatccgacggtagtgtggcaacaccaaactataattt

SEQ ID NO: 2288 - DNA, 70 bp, Artificial Sequence
  Description of Artificial Sequence: Synthetic probe
gggtgtgggaacagccttcagcttcccgatatccgacggtagtgtgcttttatgtaggagtagaagggac

SEQ ID NO: 2289 - DNA, 70 bp, Artificial Sequence
  Description of Artificial Sequence: Synthetic probe
tgcacatgggaggcggcttcagcttcccgatatccgacggtagtgttgattcagaacatcttggcaaaag

SEQ ID NO: 2290 - DNA, 70 bp, Artificial Sequence
  Description of Artificial Sequence: Synthetic probe
ctgccggaagactgtcttcagcttcccgatatccgacggtagtgtttttataacataccacatttataaa

SEQ ID NO: 2291 - DNA, 70 bp, Artificial Sequence
  Description of Artificial Sequence: Synthetic probe
ctgtctgcagtgaaaaagacttcagcttcccgatatccgacggtagtgtaatctggttactggcatctag

SEQ ID NO: 2292 - DNA, 70 bp, Artificial Sequence
  Description of Artificial Sequence: Synthetic probe
aggattagacctagggacttcagcttcccgatatccgacggtagtgtcagcaaggtcattactcttttga

SEQ ID NO: 2293 - DNA, 70 bp, Artificial Sequence
  Description of Artificial Sequence: Synthetic probe
ttgtaagataagccatctgacttcagcttcccgatatccgacggtagtgttgctaagaatgtgacttgat

SEQ ID NO: 2294 - DNA, 70 bp, Artificial Sequence
  Description of Artificial Sequence: Synthetic probe
acagtatatctaaacaataatggccttcagcttcccgatatccgacggtagtgtgtgggaacagcagttg

SEQ ID NO: 2295 - DNA, 70 bp, Artificial Sequence
  Description of Artificial Sequence: Synthetic probe
atctcttttccaaatgaggagcttcagcttcccgatatccgacggtagtgttcagatccgaaagtcaggg

SEQ ID NO: 2296 - DNA, 70 bp, Artificial Sequence
  Description of Artificial Sequence: Synthetic probe
aaggcaaactttaaatcccttcagcttcccgatatccgacggtagtgtgggtgttgtctttatttcttgt

SEQ ID NO: 2297 - DNA, 70 bp, Artificial Sequence
  Description of Artificial Sequence: Synthetic probe
cccacagctcccagttcttcagcttcccgatatccgacggtagtgtccactcagcaacaggcatagaact

SEQ ID NO: 2298 - DNA, 70 bp, Artificial Sequence
  Description of Artificial Sequence: Synthetic probe
ggtcagcacttggacaatcacttcagcttcccgatatccgacggtagtgtcagatggctgaatttaggac

SEQ ID NO: 2299 - DNA, 70 bp, Artificial Sequence
  Description of Artificial Sequence: Synthetic probe
aaaacaaaaatgcaaatacttcagcttcccgatatccgacggtagtgtatgctggctgattctgttccca

SEQ ID NO: 2300 - DNA, 70 bp, Artificial Sequence
  Description of Artificial Sequence: Synthetic probe
cgtaaattataagatttcacttcagcttcccgatatccgacggtagtgtcccaagataattaagaaccta

SEQ ID NO: 2301 - DNA, 70 bp, Artificial Sequence
  Description of Artificial Sequence: Synthetic probe
actaaggggatggtgtctgccttcagcttcccgatatccgacggtagtgtatctcttttccaaatgagga

SEQ ID NO: 2302 - DNA, 70 bp, Artificial Sequence
  Description of Artificial Sequence: Synthetic probe
atgagttctagaaggcaaacacttcagcttcccgatatccgacggtagtgtaggcaaactttaaatccac

SEQ ID NO: 2303 - DNA, 70 bp, Artificial Sequence
  Description of Artificial Sequence: Synthetic probe
tctagaaaataatcacatctcacttcagcttcccgatatccgacggtagtgtcacagctcccagtttcac

SEQ ID NO: 2304 - DNA, 70 bp, Artificial Sequence
  Description of Artificial Sequence: Synthetic probe
cattgagctgtccatgctcttccttcagcttcccgatatccgacggtagtgtttaaccttcttgttaagt

SEQ ID NO: 2305 - DNA, 70 bp, Artificial Sequence
  Description of Artificial Sequence: Synthetic probe
catctcagaagaagctgcagtcttcagcttcccgatatccgacggtagtgtaacaagaaagctactgctc

SEQ ID NO: 2306 - DNA, 70 bp, Artificial Sequence
  Description of Artificial Sequence: Synthetic probe
ggaagactgaagcatcttgcttcagcttcccgatatccgacggtagtgtagacgtcttcttcaatccaag

SEQ ID NO: 2307 - DNA, 70 bp, Artificial Sequence
  Description of Artificial Sequence: Synthetic probe
gtccactcctaattatttggacttcagcttcccgatatccgacggtagtgtggcctagtttcagcgggtt

SEQ ID NO: 2308 - DNA, 70 bp, Artificial Sequence
  Description of Artificial Sequence: Synthetic probe
caaaacctgagatactacccttcagcttcccgatatccgacggtagtgttcttgatcttcattattctca

SEQ ID NO: 2309 - DNA, 70 bp, Artificial Sequence
  Description of Artificial Sequence: Synthetic probe
tggtgaatgacagaccttcagcttcccgatatccgacggtagtgtctcaaccttgatcaatagaagtcaa

SEQ ID NO: 2310 - DNA, 70 bp, Artificial Sequence
  Description of Artificial Sequence: Synthetic probe
actcactgtggcttacagccttcagcttcccgatatccgacggtagtgttgtatgctcataaaagacaaa

SEQ ID NO: 2311 - DNA, 70 bp, Artificial Sequence
  Description of Artificial Sequence: Synthetic probe
gacgtcttcttcaatccaagtcttcagcttcccgatatccgacggtagtgtactccatttgcttaacatg

SEQ ID NO: 2312 - DNA, 70 bp, Artificial Sequence
  Description of Artificial Sequence: Synthetic probe
aggcctagtttcagcgggcttcagcttcccgatatccgacggtagtgtagtacagggaaaaactgcaata

SEQ ID NO: 2313 - DNA, 70 bp, Artificial Sequence
  Description of Artificial Sequence: Synthetic probe
cttgatcttcattattctcaaaccttcagcttcccgatatccgacggtagtgttgagctgtccatgctct

SEQ ID NO: 2314 - DNA, 70 bp, Artificial Sequence
  Description of Artificial Sequence: Synthetic probe
gattctattgtaaatattgaagacttcagcttcccgatatccgacggtagtgtctcagaagaagctgcag

SEQ ID NO: 2315 - DNA, 70 bp, Artificial Sequence
  Description of Artificial Sequence: Synthetic probe
atccaagacatgaataaaactcttcagcttcccgatatccgacggtagtgtggtgaatgacagaccgggg

SEQ ID NO: 2316 - DNA, 70 bp, Artificial Sequence
  Description of Artificial Sequence: Synthetic probe
aaccactgagacgttcctggcttcagcttcccgatatccgacggtagtgtactcactgtggcttacagcc

SEQ ID NO: 2317 - DNA, 70 bp, Artificial Sequence
  Description of Artificial Sequence: Synthetic probe
ggtacttaaatatctggcttcagcttcccgatatccgacggtagtgtgccaattccactctaaagcttag

SEQ ID NO: 2318 - DNA, 70 bp, Artificial Sequence
  Description of Artificial Sequence: Synthetic probe
cagctgtaatactactgacttggtccttcagcttcccgatatccgacggtagtgtggtagttaaaagacc

SEQ ID NO: 2319 - DNA, 70 bp, Artificial Sequence
  Description of Artificial Sequence: Synthetic probe
ttggaattgcaacatagactcttcagcttcccgatatccgacggtagtgtatcaatattgaactgacaag

SEQ ID NO: 2320 - DNA, 70 bp, Artificial Sequence
  Description of Artificial Sequence: Synthetic probe
tgaccccatccaccgctcttcagcttcccgatatccgacggtagtgtacaagtacatgttcttaagaact

SEQ ID NO: 2321 - DNA, 70 bp, Artificial Sequence
  Description of Artificial Sequence: Synthetic probe
actgacaaaaaaaaggacttcagcttcccgatatccgacggtagtgtgcatctatgtaagtcataacatg

SEQ ID NO: 2322 - DNA, 70 bp, Artificial Sequence
  Description of Artificial Sequence: Synthetic probe
tgtaaacagaccatttttctcacttcagcttcccgatatccgacggtagtgtaacaccttgatactcacc

SEQ ID NO: 2323 - DNA, 70 bp, Artificial Sequence
  Description of Artificial Sequence: Synthetic probe
atagtgacatttcactgatcttcagcttcccgatatccgacggtagtgtaggtacttaaatatctggcca

SEQ ID NO: 2324 - DNA, 70 bp, Artificial Sequence
  Description of Artificial Sequence: Synthetic probe
aatcaacaatttccttttgcttcagcttcccgatatccgacggtagtgtccagctgtaatactactgact

SEQ ID NO: 2325 - DNA, 70 bp, Artificial Sequence
  Description of Artificial Sequence: Synthetic probe
cactacctacttcaatacacttcagcttcccgatatccgacggtagtgtcttggaattgcaacatagact

SEQ ID NO: 2326 - DNA, 70 bp, Artificial Sequence
  Description of Artificial Sequence: Synthetic probe
acaaaatacatatatacacacccacttcagcttcccgatatccgacggtagtgtcccatccaccgctgca

SEQ ID NO: 2327 - DNA, 70 bp, Artificial Sequence
  Description of Artificial Sequence: Synthetic probe
tcttctccaatcatggccacttcagcttcccgatatccgacggtagtgtgtggcttatgaaagtgagatc

SEQ ID NO: 2328 - DNA, 70 bp, Artificial Sequence
  Description of Artificial Sequence: Synthetic probe
tctgggtgcatggataaggcttcagcttcccgatatccgacggtagtgtcccactattgtctaggcattt

SEQ ID NO: 2329 - DNA, 70 bp, Artificial Sequence
  Description of Artificial Sequence: Synthetic probe
aacaggaaatccaccagagtcttcagcttcccgatatccgacggtagtgtagacccaagtccacctccaa

SEQ ID NO: 2330 - DNA, 70 bp, Artificial Sequence
  Description of Artificial Sequence: Synthetic probe
catggtttaatagccagagacttcagcttcccgatatccgacggtagtgtacgctctttctacttaatgc

SEQ ID NO: 2331 - DNA, 70 bp, Artificial Sequence
  Description of Artificial Sequence: Synthetic probe
actctgcaagattcacagacttcagcttcccgatatccgacggtagtgtagtccctgggtaactacttta

SEQ ID NO: 2332 - DNA, 70 bp, Artificial Sequence
  Description of Artificial Sequence: Synthetic probe
tcacaaatagctgatgcgctccttcagcttcccgatatccgacggtagtgttttcctgctccgtgttcac

SEQ ID NO: 2333 - DNA, 70 bp, Artificial Sequence
  Description of Artificial Sequence: Synthetic probe
caaaaaaccatcaacatcaacacttcagcttcccgatatccgacggtagtgtttctccaatcatggccaa

SEQ ID NO: 2334 - DNA, 70 bp, Artificial Sequence
  Description of Artificial Sequence: Synthetic probe
gctaaaacacttaacatgcacttcagcttcccgatatccgacggtagtgttctgggtgcatggataagga

SEQ ID NO: 2335 - DNA, 70 bp, Artificial Sequence
  Description of Artificial Sequence: Synthetic probe
aatcactttttttctctaatgccttcagcttcccgatatccgacggtagtgtcaggaaatccaccagagt

SEQ ID NO: 2336 - DNA, 70 bp, Artificial Sequence
  Description of Artificial Sequence: Synthetic probe
cattatttatttatatatatatcttcagcttcccgatatccgacggtagtgttggtttaatagccagaga

SEQ ID NO: 2337 - DNA, 70 bp, Artificial Sequence
  Description of Artificial Sequence: Synthetic probe
cattgatgaaaaagcgacacccttcagcttcccgatatccgacggtagtgtaaaaactcatcatatactg

SEQ ID NO: 2338 - DNA, 70 bp, Artificial Sequence
  Description of Artificial Sequence: Synthetic probe
agtcagaccaaggacacattcctcttcagcttcccgatatccgacggtagtgtgtgatatttgacgcaac

SEQ ID NO: 2339 - DNA, 70 bp, Artificial Sequence
  Description of Artificial Sequence: Synthetic probe
aaagaaataaaactgaaatcacacttcagcttcccgatatccgacggtagtgtgaaggccagagaggcat

SEQ ID NO: 2340 - DNA, 70 bp, Artificial Sequence
  Description of Artificial Sequence: Synthetic probe
caattctatctcaaatcagttcttcagcttcccgatatccgacggtagtgtaagctagctagattactcg

SEQ ID NO: 2341 - DNA, 70 bp, Artificial Sequence
  Description of Artificial Sequence: Synthetic probe
ctaccttttctatcacatagtcttcagcttcccgatatccgacggtagtgtacactgtgaaaaggatcca

SEQ ID NO: 2342 - DNA, 70 bp, Artificial Sequence
  Description of Artificial Sequence: Synthetic probe
ccaccctatgatttcacacctcttcagcttcccgatatccgacggtagtgtaaccaagccttgatacctc

SEQ ID NO: 2343 - DNA, 70 bp, Artificial Sequence
  Description of Artificial Sequence: Synthetic probe
tcctgtaatcaggactaaagcttcagcttcccgatatccgacggtagtgtcattgatgaaaaagcgacac

SEQ ID NO: 2344 - DNA, 70 bp, Artificial Sequence
  Description of Artificial Sequence: Synthetic probe
tttaaatgaagcatccctcagcttcagcttcccgatatccgacggtagtgtagggtctaagtaaaataac

SEQ ID NO: 2345 - DNA, 70 bp, Artificial Sequence
  Description of Artificial Sequence: Synthetic probe
aaacactggcaggtatgggcttcagcttcccgatatccgacggtagtgtaagattttctccagcctagga

SEQ ID NO: 2346 - DNA, 70 bp, Artificial Sequence
  Description of Artificial Sequence: Synthetic probe
ttgtcaacaataaaaactcacttcagcttcccgatatccgacggtagtgttgataaaaagccaaaataaa

SEQ ID NO: 2347 - DNA, 70 bp, Artificial Sequence
  Description of Artificial Sequence: Synthetic probe
tactgcaaatgacgtgatatcttcagcttcccgatatccgacggtagtgtaattcaaaaagtcatcaaga

SEQ ID NO: 2348 - DNA, 70 bp, Artificial Sequence
  Description of Artificial Sequence: Synthetic probe
gcaacctgcaagagaaggccttcagcttcccgatatccgacggtagtgtaaaagacattggagaagggac

SEQ ID NO: 2349 - DNA, 70 bp, Artificial Sequence
  Description of Artificial Sequence: Synthetic probe
ggcatgggtgaaagccttcagcttcccgatatccgacggtagtgtcatttctgttttatacattgaaaac

SEQ ID NO: 2350 - DNA, 70 bp, Artificial Sequence
  Description of Artificial Sequence: Synthetic probe
actcggagctaacactgcttcagcttcccgatatccgacggtagtgtacttttaaatgaagcatccctca

SEQ ID NO: 2351 - DNA, 70 bp, Artificial Sequence
  Description of Artificial Sequence: Synthetic probe
atccaacaccaaaccaagcccttcagcttcccgatatccgacggtagtgtaaacactggcaggtatggga

SEQ ID NO: 2352 - DNA, 70 bp, Artificial Sequence
  Description of Artificial Sequence: Synthetic probe
acctcaatgtcattgatgacttcagcttcccgatatccgacggtagtgtgttgtcaacaataaaaactca

SEQ ID NO: 2353 - DNA, 70 bp, Artificial Sequence
  Description of Artificial Sequence: Synthetic probe
gacacctgtcagtcagaccaacttcagcttcccgatatccgacggtagtgtactgcaaatgacgtgatat

SEQ ID NO: 2354 - DNA, 70 bp, Artificial Sequence
  Description of Artificial Sequence: Synthetic probe
tttgtgtcctggggcacaacagtgacttcagcttcccgatatccgacggtagtgtaactatcaaggaaag

SEQ ID NO: 2355 - DNA, 70 bp, Artificial Sequence
  Description of Artificial Sequence: Synthetic probe
caatccgtgaacccctctccttcagcttcccgatatccgacggtagtgtacaataaacgatacaaagaat

SEQ ID NO: 2356 - DNA, 70 bp, Artificial Sequence
  Description of Artificial Sequence: Synthetic probe
ccgcagaacttccccacttcagcttcccgatatccgacggtagtgtagaaagcctaaaatacaacctgca

SEQ ID NO: 2357 - DNA, 70 bp, Artificial Sequence
  Description of Artificial Sequence: Synthetic probe
tgattgctgctcaggccgcttcagcttcccgatatccgacggtagtgtattatgcttggtacttggctga

SEQ ID NO: 2358 - DNA, 70 bp, Artificial Sequence
  Description of Artificial Sequence: Synthetic probe
atgctaaacacaccatcttcagcttcccgatatccgacggtagtgttgacaatcagactatctatcttgt

SEQ ID NO: 2359 - DNA, 70 bp, Artificial Sequence
  Description of Artificial Sequence: Synthetic probe
agccttaattatcacaacaagccttcagcttcccgatatccgacggtagtgtaccagcttacctgtaata

SEQ ID NO: 2360 - DNA, 70 bp, Artificial Sequence
  Description of Artificial Sequence: Synthetic probe
tctccattaactgcaattgaaacttcagcttcccgatatccgacggtagtgttgtgtcctggggcacaac

SEQ ID NO: 2361 - DNA, 70 bp, Artificial Sequence
  Description of Artificial Sequence: Synthetic probe
cacacattatgtgaaatagaagacttcagcttcccgatatccgacggtagtgttccgtgaacccctctcc

SEQ ID NO: 2362 - DNA, 70 bp, Artificial Sequence
  Description of Artificial Sequence: Synthetic probe
acaaataacaaccatgtgcctcttcagcttcccgatatccgacggtagtgtcgcagaacttccccatggg

SEQ ID NO: 2363 - DNA, 70 bp, Artificial Sequence
  Description of Artificial Sequence: Synthetic probe
tctcccactgaacctcaagactcttcagcttcccgatatccgacggtagtgtattgctgctcaggccggc

SEQ ID NO: 2364 - DNA, 70 bp, Artificial Sequence
  Description of Artificial Sequence: Synthetic probe
ttccgaatctgagctaaacttcagcttcccgatatccgacggtagtgtgagcctctaagaatctgattga

SEQ ID NO: 2365 - DNA, 70 bp, Artificial Sequence
  Description of Artificial Sequence: Synthetic probe
ctcgatgatgaacaacttctacttcagcttcccgatatccgacggtagtgtaggtaatgagggcttttca

SEQ ID NO: 2366 - DNA, 70 bp, Artificial Sequence
  Description of Artificial Sequence: Synthetic probe
tccccttggcatcttaacttcagcttcccgatatccgacggtagtgtattttaagttctcgaaattgtaa

SEQ ID NO: 2367 - DNA, 70 bp, Artificial Sequence
  Description of Artificial Sequence: Synthetic probe
aagcagtaacatttttaattacttcagcttcccgatatccgacggtagtgtacttattgtcttcacacat

SEQ ID NO: 2368 - DNA, 70 bp, Artificial Sequence
  Description of Artificial Sequence: Synthetic probe
gaaaacatttaaatagccaggcttcagcttcccgatatccgacggtagtgtcaagctaactagtcgcaaa

SEQ ID NO: 2369 - DNA, 70 bp, Artificial Sequence
  Description of Artificial Sequence: Synthetic probe
accattttacctaactcttcacacttcagcttcccgatatccgacggtagtgttggcacttacttgtcca

SEQ ID NO: 2370 - DNA, 70 bp, Artificial Sequence
  Description of Artificial Sequence: Synthetic probe
gaattaccacaactctctcttcagcttcccgatatccgacggtagtgtacttccgaatctgagctaaaac

SEQ ID NO: 2371 - DNA, 70 bp, Artificial Sequence
  Description of Artificial Sequence: Synthetic probe
gcacacttttagcagaacttcagcttcccgatatccgacggtagtgtgggctcgatgatgaacaacttct

SEQ ID NO: 2372 - DNA, 70 bp, Artificial Sequence
  Description of Artificial Sequence: Synthetic probe
gagtatgacgtctccacttcagcttcccgatatccgacggtagtgtagaaatatataatgcaaaaattaa

SEQ ID NO: 2373 - DNA, 70 bp, Artificial Sequence
  Description of Artificial Sequence: Synthetic probe
gccacacacacagactccttcagcttcccgatatccgacggtagtgtagcaaaagtgtaactattatggc

SEQ ID NO: 2374 - DNA, 70 bp, Artificial Sequence
  Description of Artificial Sequence: Synthetic probe
tttctagatgaaaatccaaactcttcagcttcccgatatccgacggtagtgtttctgccaccaaagaaac

SEQ ID NO: 2375 - DNA, 70 bp, Artificial Sequence
  Description of Artificial Sequence: Synthetic probe
gcaagtcctgaacaccacttcagcttcccgatatccgacggtagtgtctgatttgaaaacttccacaaat

SEQ ID NO: 2376 - DNA, 70 bp, Artificial Sequence
  Description of Artificial Sequence: Synthetic probe
gccacttccatcctctggcttcagcttcccgatatccgacggtagtgtaagtaacctatttgaggatgct

SEQ ID NO: 2377 - DNA, 70 bp, Artificial Sequence
  Description of Artificial Sequence: Synthetic probe
ccttctgccaccaaagaaactcttcagcttcccgatatccgacggtagtgttcccccctcactggagtct

SEQ ID NO: 2378 - DNA, 70 bp, Artificial Sequence
  Description of Artificial Sequence: Synthetic probe
ttttcacctttcaccaaagtaacttcagcttcccgatatccgacggtagtgtacctgttgtgtgctgaga

SEQ ID NO: 2379 - DNA, 70 bp, Artificial Sequence
  Description of Artificial Sequence: Synthetic probe
caagcaaattaacccagtctcttcagcttcccgatatccgacggtagtgtgagtatgacgtctccagagg

SEQ ID NO: 2380 - DNA, 70 bp, Artificial Sequence
  Description of Artificial Sequence: Synthetic probe
caagaataattgataacatttcccttcagcttcccgatatccgacggtagtgtacacacacagactcctg

SEQ ID NO: 2381 - DNA, 70 bp, Artificial Sequence
  Description of Artificial Sequence: Synthetic probe
aaatactttttaatgcttctcttcagcttcccgatatccgacggtagtgtgcaagtcctgaacaccaaca

SEQ ID NO: 2382 - DNA, 70 bp, Artificial Sequence
  Description of Artificial Sequence: Synthetic probe
tacataaaagctttcaaaaacttcagcttcccgatatccgacggtagtgtgccacttccatcctctggga

SEQ ID NO: 2383 - DNA, 70 bp, Artificial Sequence
  Description of Artificial Sequence: Synthetic probe
gggttatgatcataaatcagcttcagcttcccgatatccgacggtagtgtaatatgattcacagaatcta

SEQ ID NO: 2384 - DNA, 70 bp, Artificial Sequence
  Description of Artificial Sequence: Synthetic probe
gattgattctcagctttctcatcttcagcttcccgatatccgacggtagtgtaatgaaggtttccacatt

SEQ ID NO: 2385 - DNA, 70 bp, Artificial Sequence
  Description of Artificial Sequence: Synthetic probe
ttcaaatgcctctttaaacacttcagcttcccgatatccgacggtagtgtgaaacacctaccaaaaaaag

SEQ ID NO: 2386 - DNA, 70 bp, Artificial Sequence
  Description of Artificial Sequence: Synthetic probe
ctgtgagaagacagagaaagacttcagcttcccgatatccgacggtagtgtacatcttcgttcagatcat

SEQ ID NO: 2387 - DNA, 70 bp, Artificial Sequence
  Description of Artificial Sequence: Synthetic probe
aaaagatattcacaaaaactgcttcagcttcccgatatccgacggtagtgtttaagtacaaagtaagcta

SEQ ID NO: 2388 - DNA, 70 bp, Artificial Sequence
  Description of Artificial Sequence: Synthetic probe
ccatgggcccagcatacttcagcttcccgatatccgacggtagtgtagtaaatgacagcttagaaagtta

SEQ ID NO: 2389 - DNA, 70 bp, Artificial Sequence
  Description of Artificial Sequence: Synthetic probe
tgatacaaaccagttataacttcagcttcccgatatccgacggtagtgtagggttatgatcataaatcag

SEQ ID NO: 2390 - DNA, 70 bp, Artificial Sequence
  Description of Artificial Sequence: Synthetic probe
tacagccccaatgccaacttcagcttcccgatatccgacggtagtgttgagattgattctcagctttctc

SEQ ID NO: 2391 - DNA, 70 bp, Artificial Sequence
  Description of Artificial Sequence: Synthetic probe
cactggatttctactctgaacttcagcttcccgatatccgacggtagtgtttcaaatgcctctttaaaca

SEQ ID NO: 2392 - DNA, 70 bp, Artificial Sequence
  Description of Artificial Sequence: Synthetic probe
aattctgtaaaaaacaagttcttcagcttcccgatatccgacggtagtgtaaaaaccaactggcatctaa

SEQ ID NO: 2393 - DNA, 70 bp, Artificial Sequence
  Description of Artificial Sequence: Synthetic probe
gattcacagaatctatctgtcttcagcttcccgatatccgacggtagtgtatagcaatttttaaaaatga

SEQ ID NO: 2394 - DNA, 70 bp, Artificial Sequence
  Description of Artificial Sequence: Synthetic probe
gaaggtttccacatttcttcagcttcccgatatccgacggtagtgtcagtaaggaatttttcttctctag

SEQ ID NO: 2395 - DNA, 70 bp, Artificial Sequence
  Description of Artificial Sequence: Synthetic probe
acctaccaaaaaaaggacaaaacatcttcagcttcccgatatccgacggtagtgtttgatttccttaaca

SEQ ID NO: 2396 - DNA, 70 bp, Artificial Sequence
  Description of Artificial Sequence: Synthetic probe
cttcgttcagatcatattcttcagcttcccgatatccgacggtagtgtagagagaaaactatggaaaaga

SEQ ID NO: 2397 - DNA, 70 bp, Artificial Sequence
  Description of Artificial Sequence: Synthetic probe
gtacaaagtaagctacttcagcttcccgatatccgacggtagtgttacacatgaattattcaaaatactt

SEQ ID NO: 2398 - DNA, 70 bp, Artificial Sequence
  Description of Artificial Sequence: Synthetic probe
cagcttagaaagttacctcttcagcttcccgatatccgacggtagtgttcaattctgtaaaaaacaagtt

SEQ ID NO: 2399 - DNA, 70 bp, Artificial Sequence
  Description of Artificial Sequence: Synthetic probe
atgatcataaatcagattgagacttcagcttcccgatatccgacggtagtgtttcacagaatctatctgt

SEQ ID NO: 2400 - DNA, 70 bp, Artificial Sequence
  Description of Artificial Sequence: Synthetic probe
attctcagctttctcatgccttcagcttcccgatatccgacggtagtgttgaaggtttccacatttccaa

SEQ ID NO: 2401 - DNA, 70 bp, Artificial Sequence
  Description of Artificial Sequence: Synthetic probe
tgctctccatgactgctccttcagcttcccgatatccgacggtagtgtacatgagatgtaagtatggata

SEQ ID NO: 2402 - DNA, 70 bp, Artificial Sequence
  Description of Artificial Sequence: Synthetic probe
atcgcagacaaggtctcttcagcttcccgatatccgacggtagtgtgcagtatctgaggtaataagtgaa

SEQ ID NO: 2403 - DNA, 70 bp, Artificial Sequence
  Description of Artificial Sequence: Synthetic probe
aaaaatattgagaaataaaacacttcagcttcccgatatccgacggtagtgttggtcttcgtgacatctt

SEQ ID NO: 2404 - DNA, 70 bp, Artificial Sequence
  Description of Artificial Sequence: Synthetic probe
ccgtcaggatccctggacttcagcttcccgatatccgacggtagtgtacaccagaatgagaaaggtaagt

SEQ ID NO: 2405 - DNA, 70 bp, Artificial Sequence
  Description of Artificial Sequence: Synthetic probe
cactgctggtaactggtgccttcagcttcccgatatccgacggtagtgttggacaaggacaactacacac

SEQ ID NO: 2406 - DNA, 70 bp, Artificial Sequence
  Description of Artificial Sequence: Synthetic probe
catggtcttcgtgacatccttcagcttcccgatatccgacggtagtgtggtttttcaaaggatgccacct

SEQ ID NO: 2407 - DNA, 70 bp, Artificial Sequence
  Description of Artificial Sequence: Synthetic probe
ctaagaacaggtgtgtatggcttcagcttcccgatatccgacggtagtgtcagcatacatacttatgagg

SEQ ID NO: 2408 - DNA, 70 bp, Artificial Sequence
  Description of Artificial Sequence: Synthetic probe
tcatcaacagaacatgtagcccttcagcttcccgatatccgacggtagtgtgctctccatgactgctctc

SEQ ID NO: 2409 - DNA, 70 bp, Artificial Sequence
  Description of Artificial Sequence: Synthetic probe
gatcaaattactaacataccttcagcttcccgatatccgacggtagtgtcatcgcagacaaggtctattt

SEQ ID NO: 2410 - DNA, 70 bp, Artificial Sequence
  Description of Artificial Sequence: Synthetic probe
catgctgatgatgataaataacttcagcttcccgatatccgacggtagtgtcgtcaggatccctggacag

SEQ ID NO: 2411 - DNA, 70 bp, Artificial Sequence
  Description of Artificial Sequence: Synthetic probe
gacttttggaaaagagttgaacttcagcttcccgatatccgacggtagtgtactgctggtaactggtgca

SEQ ID NO: 2412 - DNA, 70 bp, Artificial Sequence
  Description of Artificial Sequence: Synthetic probe
tttgcagtacaatttccagtcttcagcttcccgatatccgacggtagtgtgggtcttaaaatggcaacta

SEQ ID NO: 2413 - DNA, 70 bp, Artificial Sequence
  Description of Artificial Sequence: Synthetic probe
ggttgtcttctttacatgacttcagcttcccgatatccgacggtagtgtgtcacatgttaaatctgtggt

SEQ ID NO: 2414 - DNA, 70 bp, Artificial Sequence
  Description of Artificial Sequence: Synthetic probe
agtatggataggcagtatctgacttcagcttcccgatatccgacggtagtgttgacatggtgattgtcac

SEQ ID NO: 2415 - DNA, 70 bp, Artificial Sequence
  Description of Artificial Sequence: Synthetic probe
aataagtgaagaacaccagacttcagcttcccgatatccgacggtagtgtgaagactagtagcagtcacg

SEQ ID NO: 2416 - DNA, 70 bp, Artificial Sequence
  Description of Artificial Sequence: Synthetic probe
aaaggtaagtaggctggaccttcagcttcccgatatccgacggtagtgtccttaagcactttctctgtga

SEQ ID NO: 2417 - DNA, 70 bp, Artificial Sequence
  Description of Artificial Sequence: Synthetic probe
aactacacacttcggtttttcttcagcttcccgatatccgacggtagtgttctctaccttgaagctcgtg

SEQ ID NO: 2418 - DNA, 70 bp, Artificial Sequence
  Description of Artificial Sequence: Synthetic probe
gatgccacctggtgacacttcagcttcccgatatccgacggtagtgtctttttgcagtacaatttccagt

SEQ ID NO: 2419 - DNA, 70 bp, Artificial Sequence
  Description of Artificial Sequence: Synthetic probe
acttatgaggatttatgctctccttcagcttcccgatatccgacggtagtgtttgtcttctttacatgag

SEQ ID NO: 2420 - DNA, 70 bp, Artificial Sequence
  Description of Artificial Sequence: Synthetic probe
ttctgtgacttctcagctaccatgcttcagcttcccgatatccgacggtagtgttgggccctagaaactc

SEQ ID NO: 2421 - DNA, 70 bp, Artificial Sequence
  Description of Artificial Sequence: Synthetic probe
ggaccaaatcaaagtcataggtcttcagcttcccgatatccgacggtagtgttgtctccagccctgcact

SEQ ID NO: 2422 - DNA, 70 bp, Artificial Sequence
  Description of Artificial Sequence: Synthetic probe
tggacatcagaagaatacttcagcttcccgatatccgacggtagtgtatttcaaggcctcttcagcactc

SEQ ID NO: 2423 - DNA, 70 bp, Artificial Sequence
  Description of Artificial Sequence: Synthetic probe
tgatacttttatatacttcagcttcccgatatccgacggtagtgtacagcatcaggatcagagggagcat

SEQ ID NO: 2424 - DNA, 70 bp, Artificial Sequence
  Description of Artificial Sequence: Synthetic probe
aagagaatgatcatataattcacttcagcttcccgatatccgacggtagtgttgatagcagaaaagctac

SEQ ID NO: 2425 - DNA, 70 bp, Artificial Sequence
  Description of Artificial Sequence: Synthetic probe
acatctaccagatgcagcaaatattcttcagcttcccgatatccgacggtagtgtgaagcagggtttcac

SEQ ID NO: 2426 - DNA, 70 bp, Artificial Sequence
  Description of Artificial Sequence: Synthetic probe
tcaaggcctcttcagcaccttcagcttcccgatatccgacggtagtgtatcattatataaacaagaacca

SEQ ID NO: 2427 - DNA, 70 bp, Artificial Sequence
  Description of Artificial Sequence: Synthetic probe
atcaggatcagagggagccttcagcttcccgatatccgacggtagtgtggcataaaagtaagaactccac

SEQ ID NO: 2428 - DNA, 70 bp, Artificial Sequence
  Description of Artificial Sequence: Synthetic probe
aacagtgtttagaaaacaaaacttcagcttcccgatatccgacggtagtgttctgtgacttctcagctac

SEQ ID NO: 2429 - DNA, 70 bp, Artificial Sequence
  Description of Artificial Sequence: Synthetic probe
acacaatcatttggggacttcagcttcccgatatccgacggtagtgttgaggaccaaatcaaagtcatag

SEQ ID NO: 2430 - DNA, 70 bp, Artificial Sequence
  Description of Artificial Sequence: Synthetic probe
acagacctaacaacatcttcagcttcccgatatccgacggtagtgttgccaagagaatgatcatataatt

SEQ ID NO: 2431 - DNA, 70 bp, Artificial Sequence
  Description of Artificial Sequence: Synthetic probe
gacaataaatttttctcaacttcagcttcccgatatccgacggtagtgtaacatctaccagatgcagcaa

SEQ ID NO: 2432 - DNA, 70 bp, Artificial Sequence
  Description of Artificial Sequence: Synthetic probe
atttgctgaggtggccacttcagcttcccgatatccgacggtagtgtgacaaaataacgtgagcatacat

SEQ ID NO: 2433 - DNA, 70 bp, Artificial Sequence
  Description of Artificial Sequence: Synthetic probe
ttcatatcgtttcaagtatttgcttcagcttcccgatatccgacggtagtgtagagttttcaggagtggg

SEQ ID NO: 2434 - DNA, 70 bp, Artificial Sequence
  Description of Artificial Sequence: Synthetic probe
atagtaaaccgctgatcttcagcttcccgatatccgacggtagtgtagtgaaatcagtcactgtctaaac

SEQ ID NO: 2435 - DNA, 70 bp, Artificial Sequence
  Description of Artificial Sequence: Synthetic probe
ccattttcttaagtgtattcttcagcttcccgatatccgacggtagtgtagtttaatttataccttgcct

SEQ ID NO: 2436 - DNA, 70 bp, Artificial Sequence
  Description of Artificial Sequence: Synthetic probe
tggaagatattctttgcttcagcttcccgatatccgacggtagtgtgttccaaagaagatctgaagtaga

SEQ ID NO: 2437 - DNA, 70 bp, Artificial Sequence
  Description of Artificial Sequence: Synthetic probe
aaaaatgattaatgagaactcttcagcttcccgatatccgacggtagtgtacatactaatccccacactt

SEQ ID NO: 2438 - DNA, 70 bp, Artificial Sequence
  Description of Artificial Sequence: Synthetic probe
acttgtgatattcatatataggacttcagcttcccgatatccgacggtagtgttgctgaggtggccaatg

SEQ ID NO: 2439 - DNA, 70 bp, Artificial Sequence
  Description of Artificial Sequence: Synthetic probe
agaaactagcatttacatcttcagcttcccgatatccgacggtagtgtttttcatatcgtttcaagtatt

SEQ ID NO: 2440 - DNA, 70 bp, Artificial Sequence
  Description of Artificial Sequence: Synthetic probe
taaacccaaagctacatcttcagcttcccgatatccgacggtagtgttctatagtaaaccgctgataatt

SEQ ID NO: 2441 - DNA, 70 bp, Artificial Sequence
  Description of Artificial Sequence: Synthetic probe
aatgtgtattatatattaaccttcagcttcccgatatccgacggtagtgtccattttcttaagtgtatta

SEQ ID NO: 2442 - DNA, 70 bp, Artificial Sequence
  Description of Artificial Sequence: Synthetic probe
gagcttggtgaatataactcttcagcttcccgatatccgacggtagtgtagaagttcaaattgaggctaa

SEQ ID NO: 2443 - DNA, 70 bp, Artificial Sequence
  Description of Artificial Sequence: Synthetic probe
cttcgttatacaagtttcttcagcttcccgatatccgacggtagtgtagttttaagataaattttgaagc

SEQ ID NO: 2444 - DNA, 70 bp, Artificial Sequence
  Description of Artificial Sequence: Synthetic probe
tatcaagtttaagcattctggcttcagcttcccgatatccgacggtagtgttggtgttatgaacttagga

SEQ ID NO: 2445 - DNA, 70 bp, Artificial Sequence
  Description of Artificial Sequence: Synthetic probe
tactcaggtcctgcaggacttcagcttcccgatatccgacggtagtgttcactcctttcctactaaagca

SEQ ID NO: 2446 - DNA, 70 bp, Artificial Sequence
  Description of Artificial Sequence: Synthetic probe
tcacacaaagacaggcttcttcagcttcccgatatccgacggtagtgtagcaaaaccaggagagcctcat

SEQ ID NO: 2447 - DNA, 70 bp, Artificial Sequence
  Description of Artificial Sequence: Synthetic probe
gggaagcataatggacttccttcagcttcccgatatccgacggtagtgtacataccacatacctggtact

SEQ ID NO: 2448 - DNA, 70 bp, Artificial Sequence
  Description of Artificial Sequence: Synthetic probe
accaatggtcaccaaacacttcagcttcccgatatccgacggtagtgtgtgagcttggtgaatataactt

SEQ ID NO: 2449 - DNA, 70 bp, Artificial Sequence
  Description of Artificial Sequence: Synthetic probe
tgaggaactttttaagacccttcagcttcccgatatccgacggtagtgtgcttcgttatacaagttttta

SEQ ID NO: 2450 - DNA, 70 bp, Artificial Sequence
  Description of Artificial Sequence: Synthetic probe
atcagagaatctgaagaatgggcttcagcttcccgatatccgacggtagtgttcaagtttaagcattctg

SEQ ID NO: 2451 - DNA, 70 bp, Artificial Sequence
  Description of Artificial Sequence: Synthetic probe
tgccagagttctgccgaggcttcagcttcccgatatccgacggtagtgttcctttaaagcattctaaatt

SEQ ID NO: 2452 - DNA, 70 bp, Artificial Sequence
  Description of Artificial Sequence: Synthetic probe
agctggtctttggtaaagtcttcagcttcccgatatccgacggtagtgttttatcagtgagaacaagact

SEQ ID NO: 2453 - DNA, 70 bp, Artificial Sequence
  Description of Artificial Sequence: Synthetic probe
ctctaaagctccagtgtagctcttcagcttcccgatatccgacggtagtgtagagagctttctcgtgggc

SEQ ID NO: 2454 - DNA, 70 bp, Artificial Sequence
  Description of Artificial Sequence: Synthetic probe
tagttcctatacttggaactccccttcagcttcccgatatccgacggtagtgtgggcaaacatgagcccc

SEQ ID NO: 2455 - DNA, 70 bp, Artificial Sequence
  Description of Artificial Sequence: Synthetic probe
gaaagaattacctgggaaacttcagcttcccgatatccgacggtagtgtgctcatacatgtgctcctgca

SEQ ID NO: 2456 - DNA, 70 bp, Artificial Sequence
  Description of Artificial Sequence: Synthetic probe
cagttgatcagttagtacagtcttcagcttcccgatatccgacggtagtgtgctccccataagcaatgct

SEQ ID NO: 2457 - DNA, 70 bp, Artificial Sequence
  Description of Artificial Sequence: Synthetic probe
gggctgccacacagacttcagcttcccgatatccgacggtagtgtgtctcagagtattctgccctaaatt

SEQ ID NO: 2458 - DNA, 70 bp, Artificial Sequence
  Description of Artificial Sequence: Synthetic probe
ccagttgccacatgtcttcagcttcccgatatccgacggtagtgttatttgcaaaattaccaaacaaaag

SEQ ID NO: 2459 - DNA, 70 bp, Artificial Sequence
  Description of Artificial Sequence: Synthetic probe
gagagagctttctcgtgggcttcagcttcccgatatccgacggtagtgtaaattttttaaaacctttgta

SEQ ID NO: 2460 - DNA, 70 bp, Artificial Sequence
  Description of Artificial Sequence: Synthetic probe
aacgggcaaacatgagcccttcagcttcccgatatccgacggtagtgtgtaaacatataaatgattgtac

SEQ ID NO: 2461 - DNA, 70 bp, Artificial Sequence
  Description of Artificial Sequence: Synthetic probe
ctcatacatgtgctcctgcatcttcagcttcccgatatccgacggtagtgtgccagagttctgccgaggc

SEQ ID NO: 2462 - DNA, 70 bp, Artificial Sequence
  Description of Artificial Sequence: Synthetic probe
tgctccccataagcaatgccttcagcttcccgatatccgacggtagtgtcagctggtctttggtaaagtt

SEQ ID NO: 2463 - DNA, 70 bp, Artificial Sequence
  Description of Artificial Sequence: Synthetic probe
cctgtgacaagaggagatttagcttcagcttcccgatatccgacggtagtgtgctgccacacagagggct

SEQ ID NO: 2464 - DNA, 70 bp, Artificial Sequence
  Description of Artificial Sequence: Synthetic probe
tgaggaggaaatatgacaacttcagcttcccgatatccgacggtagtgttccagttgccacatgtcagaa

SEQ ID NO: 2465 - DNA, 70 bp, Artificial Sequence
  Description of Artificial Sequence: Synthetic probe
tccaaaaccatggccgcacttcagcttcccgatatccgacggtagtgtagataagacctctggggcaaac

SEQ ID NO: 2466 - DNA, 70 bp, Artificial Sequence
  Description of Artificial Sequence: Synthetic probe
gcttcctctgctcaaccagccttcagcttcccgatatccgacggtagtgtctctggacttaacaattatg

SEQ ID NO: 2467 - DNA, 70 bp, Artificial Sequence
  Description of Artificial Sequence: Synthetic probe
tgtagagacaataagcagccttcagcttcccgatatccgacggtagtgtgttcctttaactttcatgatc

SEQ ID NO: 2468 - DNA, 70 bp, Artificial Sequence
  Description of Artificial Sequence: Synthetic probe
ctacaaagttaaacagatactttcttcagcttcccgatatccgacggtagtgtacaattgagaagacctt

SEQ ID NO: 2469 - DNA, 70 bp, Artificial Sequence
  Description of Artificial Sequence: Synthetic probe
ctcaagtgcttctttaatatgcttcagcttcccgatatccgacggtagtgttgactggggggtttagaag

SEQ ID NO: 2470 - DNA, 70 bp, Artificial Sequence
  Description of Artificial Sequence: Synthetic probe
tattatgtatgaaactatgtactcttcagcttcccgatatccgacggtagtgttgagtttacctgggcac

SEQ ID NO: 2471 - DNA, 70 bp, Artificial Sequence
  Description of Artificial Sequence: Synthetic probe
ctgaatttctgtgagggaatcttcagcttcccgatatccgacggtagtgttccaaaaccatggccgcatc

SEQ ID NO: 2472 - DNA, 70 bp, Artificial Sequence
  Description of Artificial Sequence: Synthetic probe
tatacaccacagagtcctatctcttcagcttcccgatatccgacggtagtgtttcctctgctcaaccagc

SEQ ID NO: 2473 - DNA, 70 bp, Artificial Sequence
  Description of Artificial Sequence: Synthetic probe
gcctcaaagcttcttcccacttcagcttcccgatatccgacggtagtgtaaaacaccgcttttccttaag

SEQ ID NO: 2474 - DNA, 70 bp, Artificial Sequence
  Description of Artificial Sequence: Synthetic probe
tccttctaacagcaagagccttcagcttcccgatatccgacggtagtgtgaacctgacctatttctactt

SEQ ID NO: 2475 - DNA, 70 bp, Artificial Sequence
  Description of Artificial Sequence: Synthetic probe
tcttcataatcctgacaagggcttcagcttcccgatatccgacggtagtgttgaacctcagaagacaaga

SEQ ID NO: 2476 - DNA, 70 bp, Artificial Sequence
  Description of Artificial Sequence: Synthetic probe
ggaagaagacaacaagtgacttcagcttcccgatatccgacggtagtgtccaactgacctggaatccctt

SEQ ID NO: 2477 - DNA, 70 bp, Artificial Sequence
  Description of Artificial Sequence: Synthetic probe
catgtcagatgtcatcacagccttcagcttcccgatatccgacggtagtgttctctctgcttagcaccca

SEQ ID NO: 2478 - DNA, 70 bp, Artificial Sequence
  Description of Artificial Sequence: Synthetic probe
tacaaaactaaccacagaccttcagcttcccgatatccgacggtagtgtccagaggatttacaagattct

SEQ ID NO: 2479 - DNA, 70 bp, Artificial Sequence
  Description of Artificial Sequence: Synthetic probe
ctatctccctggccaggggcttcagcttcccgatatccgacggtagtgtagcctcaaagcttcttcccag

SEQ ID NO: 2480 - DNA, 70 bp, Artificial Sequence
  Description of Artificial Sequence: Synthetic probe
cctagttctcaacatcatgcccttcagcttcccgatatccgacggtagtgtccttctaacagcaagagca

SEQ ID NO: 2481 - DNA, 70 bp, Artificial Sequence
  Description of Artificial Sequence: Synthetic probe
caccagctcttggtcacttcagcttcccgatatccgacggtagtgtggtattatactggttcataattgg

SEQ ID NO: 2482 - DNA, 70 bp, Artificial Sequence
  Description of Artificial Sequence: Synthetic probe
ctcataacagagataccactgcttcagcttcccgatatccgacggtagtgtactggttcaaagaaatttt

SEQ ID NO: 2483 - DNA, 70 bp, Artificial Sequence
  Description of Artificial Sequence: Synthetic probe
cactcccaacacactccagccttcagcttcccgatatccgacggtagtgtattcaagcagcctaaagctg

SEQ ID NO: 2484 - DNA, 70 bp, Artificial Sequence
  Description of Artificial Sequence: Synthetic probe
cagagaaaattgaaaagagacttcagcttcccgatatccgacggtagtgtgcctgtaagacatctggaat

SEQ ID NO: 2485 - DNA, 70 bp, Artificial Sequence
  Description of Artificial Sequence: Synthetic probe
aaacactagcatctcagtcttcagcttcccgatatccgacggtagtgtgttttaaaaaagccagtgaggc

SEQ ID NO: 2486 - DNA, 70 bp, Artificial Sequence
  Description of Artificial Sequence: Synthetic probe
gactgcaacttcaatcaaaacacttcagcttcccgatatccgacggtagtgtacaagcttacctgtggca

SEQ ID NO: 2487 - DNA, 70 bp, Artificial Sequence
  Description of Artificial Sequence: Synthetic probe
aaaaaaacaaaacgaaaagacacttcagcttcccgatatccgacggtagtgtccagctcttggtcaggac

SEQ ID NO: 2488 - DNA, 70 bp, Artificial Sequence
  Description of Artificial Sequence: Synthetic probe
gtatatggaagagatatctgccttcagcttcccgatatccgacggtagtgttcataacagagataccact

SEQ ID NO: 2489 - DNA, 70 bp, Artificial Sequence
  Description of Artificial Sequence: Synthetic probe
aggctttacgttggtttctcttcagcttcccgatatccgacggtagtgtattatatccaggtggtaattt

SEQ ID NO: 2490 - DNA, 70 bp, Artificial Sequence
  Description of Artificial Sequence: Synthetic probe
tccagtctgttatatttgtataccttcagcttcccgatatccgacggtagtgttctacatgacatattat

SEQ ID NO: 2491 - DNA, 70 bp, Artificial Sequence
  Description of Artificial Sequence: Synthetic probe
agaaggaaaaacacaatcttcagcttcccgatatccgacggtagtgtagaaaacacagtaaataggagga

SEQ ID NO: 2492 - DNA, 70 bp, Artificial Sequence
  Description of Artificial Sequence: Synthetic probe
gaaggaaaacttctagtcaccttcagcttcccgatatccgacggtagtgttctcatctctctctcctcac

SEQ ID NO: 2493 - DNA, 70 bp, Artificial Sequence
  Description of Artificial Sequence: Synthetic probe
agttaagatacttagaaagaccttcagcttcccgatatccgacggtagtgtccaaatgaggaattctatc

SEQ ID NO: 2494 - DNA, 70 bp, Artificial Sequence
  Description of Artificial Sequence: Synthetic probe
attactttcagaggtaatcacttcagcttcccgatatccgacggtagtgttggaaccctcaccttctaaa

SEQ ID NO: 2495 - DNA, 70 bp, Artificial Sequence
  Description of Artificial Sequence: Synthetic probe
ttttcctgaaaaacaggcctcttcagcttcccgatatccgacggtagtgtaggctttacgttggtttcta

SEQ ID NO: 2496 - DNA, 70 bp, Artificial Sequence
  Description of Artificial Sequence: Synthetic probe
aaggcagccaaggaaattcacttcagcttcccgatatccgacggtagtgttccagtctgttatatttgta

SEQ ID NO: 2497 - DNA, 70 bp, Artificial Sequence
  Description of Artificial Sequence: Synthetic probe
acctgcctgctgggcttgcttcagcttcccgatatccgacggtagtgtgggccctgaaggggctccacag

SEQ ID NO: 2498 - DNA, 70 bp, Artificial Sequence
  Description of Artificial Sequence: Synthetic probe
agctctcgaactaccaataaacgcttcagcttcccgatatccgacggtagtgtcacttgcccatggcaca

SEQ ID NO: 2499 - DNA, 70 bp, Artificial Sequence
  Description of Artificial Sequence: Synthetic probe
tcttgtggcgactgaatgtggcttcagcttcccgatatccgacggtagtgtagattgcaggcggatcacc

SEQ ID NO: 2500 - DNA, 70 bp, Artificial Sequence
  Description of Artificial Sequence: Synthetic probe
ctgagagtccagaaatgccacttcagcttcccgatatccgacggtagtgtatctagacaatgtgtggcgt

SEQ ID NO: 2501 - DNA, 70 bp, Artificial Sequence
  Description of Artificial Sequence: Synthetic probe
tttttctgggctggagatgcagaacttcagcttcccgatatccgacggtagtgtccactgcccccgcacg

SEQ ID NO: 2502 - DNA, 70 bp, Artificial Sequence
  Description of Artificial Sequence: Synthetic probe
ggaaaatagtttgagcatgacttcagcttcccgatatccgacggtagtgtggccttcacgcagatactca

SEQ ID NO: 2503 - DNA, 70 bp, Artificial Sequence
  Description of Artificial Sequence: Synthetic probe
aagcaaagagaaaaaactaaaggccttcagcttcccgatatccgacggtagtgtgcctgctgggcttgct

SEQ ID NO: 2504 - DNA, 70 bp, Artificial Sequence
  Description of Artificial Sequence: Synthetic probe
gggagcagtgaaggagggcttcagcttcccgatatccgacggtagtgttgagctctcgaactaccaataa

SEQ ID NO: 2505 - DNA, 70 bp, Artificial Sequence
  Description of Artificial Sequence: Synthetic probe
tcagcaaaaagaaagaggttcttcagcttcccgatatccgacggtagtgttcttgtggcgactgaatgtg

SEQ ID NO: 2506 - DNA, 70 bp, Artificial Sequence
  Description of Artificial Sequence: Synthetic probe
gttttccaagcgagctctcttcagcttcccgatatccgacggtagtgtgtctgagagtccagaaatgcca

SEQ ID NO: 2507 - DNA, 70 bp, Artificial Sequence
  Description of Artificial Sequence: Synthetic probe
ctgatatcctggagttactcttcagcttcccgatatccgacggtagtgttgggaaagtgtctgaacaact

SEQ ID NO: 2508 - DNA, 70 bp, Artificial Sequence
  Description of Artificial Sequence: Synthetic probe
gtatttgccactcatctcaccttcagcttcccgatatccgacggtagtgtacagcgctgaagaatattct

SEQ ID NO: 2509 - DNA, 70 bp, Artificial Sequence
  Description of Artificial Sequence: Synthetic probe
ctcacgacactgctagtttcacttcagcttcccgatatccgacggtagtgttcccactacaccgtcccag

SEQ ID NO: 2510 - DNA, 70 bp, Artificial Sequence
  Description of Artificial Sequence: Synthetic probe
agaggtctgactcttgccccttcagcttcccgatatccgacggtagtgtaaaccaatctatttgcttcca

SEQ ID NO: 2511 - DNA, 70 bp, Artificial Sequence
  Description of Artificial Sequence: Synthetic probe
tacctcatcatctagaaaacttcagcttcccgatatccgacggtagtgtccctatatgcccaggatatag

SEQ ID NO: 2512 - DNA, 70 bp, Artificial Sequence
  Description of Artificial Sequence: Synthetic probe
ccagaagccgatgaaaacacttcagcttcccgatatccgacggtagtgttgtgctgaatcaatgtgatac

SEQ ID NO: 2513 - DNA, 70 bp, Artificial Sequence
  Description of Artificial Sequence: Synthetic probe
gctaatgtgtgggtttaccttcagcttcccgatatccgacggtagtgtcgctgatatcctggagttacta

SEQ ID NO: 2514 - DNA, 70 bp, Artificial Sequence
  Description of Artificial Sequence: Synthetic probe
gcggtaaatgaactaactagagtcttcagcttcccgatatccgacggtagtgttttgccactcatctcac

SEQ ID NO: 2515 - DNA, 70 bp, Artificial Sequence
  Description of Artificial Sequence: Synthetic probe
actggtgcatatcaaaggacttcagcttcccgatatccgacggtagtgtactcacgacactgctagtttc

SEQ ID NO: 2516 - DNA, 70 bp, Artificial Sequence
  Description of Artificial Sequence: Synthetic probe
aaaatgattgcaaagttgatctcttcagcttcccgatatccgacggtagtgtaggtctgactcttgcccg

SEQ ID NO: 2517 - DNA, 70 bp, Artificial Sequence
  Description of Artificial Sequence: Synthetic probe
gtgttctgcaccacttcaccttcagcttcccgatatccgacggtagtgtacccttcctgctaaaagttct

SEQ ID NO: 2518 - DNA, 70 bp, Artificial Sequence
  Description of Artificial Sequence: Synthetic probe
cctccaggagggccacttcagcttcccgatatccgacggtagtgtcatctttcctcaaattgggaaaatg

SEQ ID NO: 2519 - DNA, 70 bp, Artificial Sequence
  Description of Artificial Sequence: Synthetic probe
cggactgccttctttgacttcagcttcccgatatccgacggtagtgtagcttaatcacctactgaactct

SEQ ID NO: 2520 - DNA, 70 bp, Artificial Sequence
  Description of Artificial Sequence: Synthetic probe
ttcttccgctccgctcttcagcttcccgatatccgacggtagtgtgcctgtctgtactgcctattcacta

SEQ ID NO: 2521 - DNA, 70 bp, Artificial Sequence
  Description of Artificial Sequence: Synthetic probe
tcttggatgatctcctgttcttcagcttcccgatatccgacggtagtgtttgtggtcaggaatcatcatc

SEQ ID NO: 2522 - DNA, 70 bp, Artificial Sequence
  Description of Artificial Sequence: Synthetic probe
tacacagatatttttaagcccttcagcttcccgatatccgacggtagtgttgagaatatacctttcaggt

SEQ ID NO: 2523 - DNA, 70 bp, Artificial Sequence
  Description of Artificial Sequence: Synthetic probe
agtagctaggactacaggcacttcagcttcccgatatccgacggtagtgtgtgttctgcaccacttcact

SEQ ID NO: 2524 - DNA, 70 bp, Artificial Sequence
  Description of Artificial Sequence: Synthetic probe
taccttgcctggctactttcttcttcagcttcccgatatccgacggtagtgttccaggagggccaggtcc

SEQ ID NO: 2525 - DNA, 70 bp, Artificial Sequence
  Description of Artificial Sequence: Synthetic probe
gttgctgatgaccccacacacttcagcttcccgatatccgacggtagtgtcggactgccttctttgaggc

SEQ ID NO: 2526 - DNA, 70 bp, Artificial Sequence
  Description of Artificial Sequence: Synthetic probe
acagatctccattttaaattcctcttcagcttcccgatatccgacggtagtgtttccgctccgcttttcg

SEQ ID NO: 2527 - DNA, 70 bp, Artificial Sequence
  Description of Artificial Sequence: Synthetic probe
gtagctgaattctgctggcttcagcttcccgatatccgacggtagtgtactgacagcttacacataaatc

SEQ ID NO: 2528 - DNA, 70 bp, Artificial Sequence
  Description of Artificial Sequence: Synthetic probe
gagtccaaatttctggacttcagcttcccgatatccgacggtagtgtagataatttaactatggcatctt

SEQ ID NO: 2529 - DNA, 70 bp, Artificial Sequence
  Description of Artificial Sequence: Synthetic probe
cactgcaggtcctttctcccttcagcttcccgatatccgacggtagtgttgttcatcaaactcaaagaga

SEQ ID NO: 2530 - DNA, 70 bp, Artificial Sequence
  Description of Artificial Sequence: Synthetic probe
atcttttttcttcccaacttcagcttcccgatatccgacggtagtgtgagtacctttaaaatatggtata

SEQ ID NO: 2531 - DNA, 70 bp, Artificial Sequence
  Description of Artificial Sequence: Synthetic probe
ttccatcaactgcagcgcttcagcttcccgatatccgacggtagtgtgttttaagaacaggaaaactttt

SEQ ID NO: 2532 - DNA, 70 bp, Artificial Sequence
  Description of Artificial Sequence: Synthetic probe
aaggccttctgtaattccctcttcagcttcccgatatccgacggtagtgttggagattgtgtgaatacaa

SEQ ID NO: 2533 - DNA, 70 bp, Artificial Sequence
  Description of Artificial Sequence: Synthetic probe
gttcatcaaactcaaagacttcagcttcccgatatccgacggtagtgtcccatgaaaatgatgaaaaaaa

SEQ ID NO: 2534 - DNA, 70 bp, Artificial Sequence
  Description of Artificial Sequence: Synthetic probe
tacctttaaaatatggtataccttcagcttcccgatatccgacggtagtgtccgtctctgagaaaactta

SEQ ID NO: 2535 - DNA, 70 bp, Artificial Sequence
  Description of Artificial Sequence: Synthetic probe
tctagagagaagaaatttgaaacttcagcttcccgatatccgacggtagtgtagctgaattctgctggta

SEQ ID NO: 2536 - DNA, 70 bp, Artificial Sequence
  Description of Artificial Sequence: Synthetic probe
tggtaagttatattcccagccttcagcttcccgatatccgacggtagtgtgagtccaaatttctggaagt

SEQ ID NO: 2537 - DNA, 70 bp, Artificial Sequence
  Description of Artificial Sequence: Synthetic probe
tgacagaatcatacatagcttcttcagcttcccgatatccgacggtagtgttccatcaactgcagcgtat

SEQ ID NO: 2538 - DNA, 70 bp, Artificial Sequence
  Description of Artificial Sequence: Synthetic probe
ccaaagccaaaaatttctcttcagcttcccgatatccgacggtagtgtcaaaggccttctgtaattccct

SEQ ID NO: 2539 - DNA, 70 bp, Artificial Sequence
  Description of Artificial Sequence: Synthetic probe
gaaccgaagtcttctgttgcttcagcttcccgatatccgacggtagtgtagaattgaggaagaattgtag

SEQ ID NO: 2540 - DNA, 70 bp, Artificial Sequence
  Description of Artificial Sequence: Synthetic probe
agatgccatgatactatttgccttcagcttcccgatatccgacggtagtgtttttgtagtgaaaaattgt

SEQ ID NO: 2541 - DNA, 70 bp, Artificial Sequence
  Description of Artificial Sequence: Synthetic probe
gaattgggacctagaacctgacttcagcttcccgatatccgacggtagtgttctctccttatactgctga

SEQ ID NO: 2542 - DNA, 70 bp, Artificial Sequence
  Description of Artificial Sequence: Synthetic probe
aaaatagactgtatcagcacttcagcttcccgatatccgacggtagtgtctcaatacttacagaaagata

SEQ ID NO: 2543 - DNA, 70 bp, Artificial Sequence
  Description of Artificial Sequence: Synthetic probe
atctaatacttctcaagactcttcagcttcccgatatccgacggtagtgttctgcttagtattgtaatat

SEQ ID NO: 2544 - DNA, 70 bp, Artificial Sequence
  Description of Artificial Sequence: Synthetic probe
taccaaaggccaaatccccttcagcttcccgatatccgacggtagtgtatgagaaaaaatactaaccaag

SEQ ID NO: 2545 - DNA, 70 bp, Artificial Sequence
  Description of Artificial Sequence: Synthetic probe
agaaaacagcctgtcatttcttcagcttcccgatatccgacggtagtgtggaaccgaagtcttctgttgc

SEQ ID NO: 2546 - DNA, 70 bp, Artificial Sequence
  Description of Artificial Sequence: Synthetic probe
gtatggtgtgaaacacagtcttcagcttcccgatatccgacggtagtgtaagatgccatgatactatttg

SEQ ID NO: 2547 - DNA, 70 bp, Artificial Sequence
  Description of Artificial Sequence: Synthetic probe
cagtctagcaggctcagctcttcagcttcccgatatccgacggtagtgtgtctgctgaagttcttggcaa

SEQ ID NO: 2548 - DNA, 70 bp, Artificial Sequence
  Description of Artificial Sequence: Synthetic probe
gggttcttctgttgacttcagcttcccgatatccgacggtagtgttgctaaggtaagttatcattttact

SEQ ID NO: 2549 - DNA, 70 bp, Artificial Sequence
  Description of Artificial Sequence: Synthetic probe
tataaaaagctcagcatctcttcagcttcccgatatccgacggtagtgtccagttctcaatagccagccc

SEQ ID NO: 2550 - DNA, 70 bp, Artificial Sequence
  Description of Artificial Sequence: Synthetic probe
aagaaaggaagggaaattgtgacttcagcttcccgatatccgacggtagtgtgcaaggggtggtaggaca

SEQ ID NO: 2551 - DNA, 70 bp, Artificial Sequence
  Description of Artificial Sequence: Synthetic probe
acatactcttgttggagggccttcagcttcccgatatccgacggtagtgtaatgagtggaaatggtcttc

SEQ ID NO: 2552 - DNA, 70 bp, Artificial Sequence
  Description of Artificial Sequence: Synthetic probe
ggcagtaactctaaactaaacttcagcttcccgatatccgacggtagtgtcggatccctcctaactgcag

SEQ ID NO: 2553 - DNA, 70 bp, Artificial Sequence
  Description of Artificial Sequence: Synthetic probe
taggcaggtggagtttgcacttcagcttcccgatatccgacggtagtgttcagtctagcaggctcagctt

SEQ ID NO: 2554 - DNA, 70 bp, Artificial Sequence
  Description of Artificial Sequence: Synthetic probe
agaccatcagagccagacttcagcttcccgatatccgacggtagtgtactgggttcttctgttgatcttt

SEQ ID NO: 2555 - DNA, 70 bp, Artificial Sequence
  Description of Artificial Sequence: Synthetic probe
ttcaccaaaatcatcctgacttcagcttcccgatatccgacggtagtgtgctgaaggaactgggctaata

SEQ ID NO: 2556 - DNA, 70 bp, Artificial Sequence
  Description of Artificial Sequence: Synthetic probe
tgctgctccaggattggcttcagcttcccgatatccgacggtagtgtcatttaatagctgggggtttaac

SEQ ID NO: 2557 - DNA, 70 bp, Artificial Sequence
  Description of Artificial Sequence: Synthetic probe
cttttgtcatcataatcagggcttcagcttcccgatatccgacggtagtgtagttctttggcctaatgac

SEQ ID NO: 2558 - DNA, 70 bp, Artificial Sequence
  Description of Artificial Sequence: Synthetic probe
ttgaccttagagaaacaccttcagcttcccgatatccgacggtagtgtgctattagtgcacaaggaaatg

SEQ ID NO: 2559 - DNA, 70 bp, Artificial Sequence
  Description of Artificial Sequence: Synthetic probe
aatgattttgttttcatgtaacacttcagcttcccgatatccgacggtagtgttgggaagaaacgtaggt

SEQ ID NO: 2560 - DNA, 70 bp, Artificial Sequence
  Description of Artificial Sequence: Synthetic probe
tttgccattcctaagtacccttcagcttcccgatatccgacggtagtgtaaatattgcacaaagctatac

SEQ ID NO: 2561 - DNA, 70 bp, Artificial Sequence
  Description of Artificial Sequence: Synthetic probe
actgtaagctaaggagctggcttcagcttcccgatatccgacggtagtgtttcaccaaaatcatcctgat

SEQ ID NO: 2562 - DNA, 70 bp, Artificial Sequence
  Description of Artificial Sequence: Synthetic probe
gtctgaacagagcagacagacttcagcttcccgatatccgacggtagtgttgctgctccaggattggctc

SEQ ID NO: 2563 - DNA, 70 bp, Artificial Sequence
  Description of Artificial Sequence: Synthetic probe
tccaaaatgctttgacttcttcagcttcccgatatccgacggtagtgtatcttttgtcatcataatcagg

SEQ ID NO: 2564 - DNA, 70 bp, Artificial Sequence
  Description of Artificial Sequence: Synthetic probe
tctgaaaagctgcttgtctgcttcagcttcccgatatccgacggtagtgttcctgaaggttctaggcagt

SEQ ID NO: 2565 - DNA, 70 bp, Artificial Sequence
  Description of Artificial Sequence: Synthetic probe
tgatccatggaactgtgtcttcagcttcccgatatccgacggtagtgtactaaagcagaagagaactgtt

SEQ ID NO: 2566 - DNA, 70 bp, Artificial Sequence
  Description of Artificial Sequence: Synthetic probe
ctaccccatccaacagtgacttcagcttcccgatatccgacggtagtgtactggcatctaagtggacacc

SEQ ID NO: 2567 - DNA, 70 bp, Artificial Sequence
  Description of Artificial Sequence: Synthetic probe
tgcctacagaacaattggcacttcagcttcccgatatccgacggtagtgtgttcctggtgggtggcaaac

SEQ ID NO: 2568 - DNA, 70 bp, Artificial Sequence
  Description of Artificial Sequence: Synthetic probe
actaataagccacatgaaatgacttcagcttcccgatatccgacggtagtgttgttccagtcaaggcttt

SEQ ID NO: 2569 - DNA, 70 bp, Artificial Sequence
  Description of Artificial Sequence: Synthetic probe
aaaaacagtttcactgctcttcagcttcccgatatccgacggtagtgttccatcaaaccaaacttaccat

SEQ ID NO: 2570 - DNA, 70 bp, Artificial Sequence
  Description of Artificial Sequence: Synthetic probe
atgaagttagtcattggcaacttcagcttcccgatatccgacggtagtgttctgaaaagctgcttgtctg

SEQ ID NO: 2571 - DNA, 70 bp, Artificial Sequence
  Description of Artificial Sequence: Synthetic probe
caggtcctctaacgcctccttcagcttcccgatatccgacggtagtgttctgatccatggaactgtgtct

SEQ ID NO: 2572 - DNA, 70 bp, Artificial Sequence
  Description of Artificial Sequence: Synthetic probe
attgaccagcagtcaatatttgcttcagcttcccgatatccgacggtagtgtaccccatccaacagtgat

SEQ ID NO: 2573 - DNA, 70 bp, Artificial Sequence
  Description of Artificial Sequence: Synthetic probe
tgtttctgggcaaacaacacttcagcttcccgatatccgacggtagtgtaactctaacctcatttcacat

SEQ ID NO: 2574 - DNA, 70 bp, Artificial Sequence
  Description of Artificial Sequence: Synthetic probe
gcaaaaaactgtccatcccccttcagcttcccgatatccgacggtagtgtgcagcacatccttgcctcat

SEQ ID NO: 2575 - DNA, 70 bp, Artificial Sequence
  Description of Artificial Sequence: Synthetic probe
aggtaacttgtggtctcttcagcttcccgatatccgacggtagtgttgtataattaataccctactcaaa

SEQ ID NO: 2576 - DNA, 70 bp, Artificial Sequence
  Description of Artificial Sequence: Synthetic probe
ccagggcaaagcagacttcagcttcccgatatccgacggtagtgtgcaaaagaaagaaaattttccttaa

SEQ ID NO: 2577 - DNA, 70 bp, Artificial Sequence
  Description of Artificial Sequence: Synthetic probe
aaaggggaacaaacaccaatattaccttcagcttcccgatatccgacggtagtgtataaaaattttttat

SEQ ID NO: 2578 - DNA, 70 bp, Artificial Sequence
  Description of Artificial Sequence: Synthetic probe
tgggggaccttaagtcttcagcttcccgatatccgacggtagtgttgttgtttaactgcaatatatttcc

SEQ ID NO: 2579 - DNA, 70 bp, Artificial Sequence
  Description of Artificial Sequence: Synthetic probe
caaacaagcctcagaccacttcagcttcccgatatccgacggtagtgtcctgtttctgggcaaacaacac

SEQ ID NO: 2580 - DNA, 70 bp, Artificial Sequence
  Description of Artificial Sequence: Synthetic probe
cagatgttttttaagaggttcttcagcttcccgatatccgacggtagtgtgcaaaaaactgtccatcccc

SEQ ID NO: 2581 - DNA, 70 bp, Artificial Sequence
  Description of Artificial Sequence: Synthetic probe
tactttgaaagcctgcctcttcagcttcccgatatccgacggtagtgtccaggtaacttgtggtctatgg

SEQ ID NO: 2582 - DNA, 70 bp, Artificial Sequence
  Description of Artificial Sequence: Synthetic probe
tccaagccagggctggtcccttcagcttcccgatatccgacggtagtgtagaaacaaagatagatacagc

SEQ ID NO: 2583 - DNA, 70 bp, Artificial Sequence
  Description of Artificial Sequence: Synthetic probe
tgccacaggctcactggtcttcagcttcccgatatccgacggtagtgtataaccaaatgaagaaacgtaa

SEQ ID NO: 2584 - DNA, 70 bp, Artificial Sequence
  Description of Artificial Sequence: Synthetic probe
aaagcaaactctcggttcccttcagcttcccgatatccgacggtagtgtccttttgtgttacacaaacat

SEQ ID NO: 2585 - DNA, 70 bp, Artificial Sequence
  Description of Artificial Sequence: Synthetic probe
tgaccttccgagcccccttcagcttcccgatatccgacggtagtgttgtatcatctgtatccatgtgtac

SEQ ID NO: 2586 - DNA, 70 bp, Artificial Sequence
  Description of Artificial Sequence: Synthetic probe
gtggagtcaaacacacacttcagcttcccgatatccgacggtagtgtccacctctactctggttccaaga

SEQ ID NO: 2587 - DNA, 70 bp, Artificial Sequence
  Description of Artificial Sequence: Synthetic probe
taaaacattatgataaaagttgtccttcagcttcccgatatccgacggtagtgtaggtttcttctcccac

SEQ ID NO: 2588 - DNA, 70 bp, Artificial Sequence
  Description of Artificial Sequence: Synthetic probe
attcagaactattcaaacaccttcccttcagcttcccgatatccgacggtagtgtgccagggctggtccc

SEQ ID NO: 2589 - DNA, 70 bp, Artificial Sequence
  Description of Artificial Sequence: Synthetic probe
ttacaaataaaaactgccatggcttcagcttcccgatatccgacggtagtgtccacaggctcactggttg

SEQ ID NO: 2590 - DNA, 70 bp, Artificial Sequence
  Description of Artificial Sequence: Synthetic probe
tacatagccaattagattaattcttcagcttcccgatatccgacggtagtgtagcaaactctcggttcca

SEQ ID NO: 2591 - DNA, 70 bp, Artificial Sequence
  Description of Artificial Sequence: Synthetic probe
aggaagggaagtgtaaagtgtcttcagcttcccgatatccgacggtagtgtccgagattgcactatcgca

SEQ ID NO: 2592 - DNA, 70 bp, Artificial Sequence
  Description of Artificial Sequence: Synthetic probe
gaaggagtccatttttctcacttcagcttcccgatatccgacggtagtgtacctgggcaacaagaatgaa

SEQ ID NO: 2593 - DNA, 70 bp, Artificial Sequence
  Description of Artificial Sequence: Synthetic probe
cacaatatcctgctggtcttcagcttcccgatatccgacggtagtgttccatctcaaaaaaaaaaaaaaa

SEQ ID NO: 2594 - DNA, 70 bp, Artificial Sequence
  Description of Artificial Sequence: Synthetic probe
tcttgtgtagatgcaatcacttcagcttcccgatatccgacggtagtgttccctctatagctatggaaag

SEQ ID NO: 2595 - DNA, 70 bp, Artificial Sequence
  Description of Artificial Sequence: Synthetic probe
ctgagggtcttaaagcaaactcttcagcttcccgatatccgacggtagtgtacattcgagggtgaaacaa

SEQ ID NO: 2596 - DNA, 70 bp, Artificial Sequence
  Description of Artificial Sequence: Synthetic probe
gtgttacaatatcgaaagctcttcagcttcccgatatccgacggtagtgtggcacttaccttaacctcat

SEQ ID NO: 2597 - DNA, 70 bp, Artificial Sequence
  Description of Artificial Sequence: Synthetic probe
aactaaagaatagataaaatcccttcagcttcccgatatccgacggtagtgtgaagggaagtgtaaagtg

SEQ ID NO: 2598 - DNA, 70 bp, Artificial Sequence
  Description of Artificial Sequence: Synthetic probe
agagttttttttccagcaaacatgacttcagcttcccgatatccgacggtagtgtagtccatttttctca

SEQ ID NO: 2599 - DNA, 70 bp, Artificial Sequence
  Description of Artificial Sequence: Synthetic probe
atgaatgaatgaacgaattcttcagcttcccgatatccgacggtagtgtacacaatatcctgctggttgg

SEQ ID NO: 2600 - DNA, 70 bp, Artificial Sequence
  Description of Artificial Sequence: Synthetic probe
tatctttatccaaggaagttcttcagcttcccgatatccgacggtagtgttcttgtgtagatgcaatcaa

SEQ ID NO: 2601 - DNA, 70 bp, Artificial Sequence
  Description of Artificial Sequence: Synthetic probe
ctttcttctctctgaaggtctcttcagcttcccgatatccgacggtagtgtccacctacccacttcagca

SEQ ID NO: 2602 - DNA, 70 bp, Artificial Sequence
  Description of Artificial Sequence: Synthetic probe
gccagactgcaagcacttcagcttcccgatatccgacggtagtgttctttgattctactaagggactaag

SEQ ID NO: 2603 - DNA, 70 bp, Artificial Sequence
  Description of Artificial Sequence: Synthetic probe
tgcattccagagcaagtcacttcagcttcccgatatccgacggtagtgtagggatgaaggaaatcccata

SEQ ID NO: 2604 - DNA, 70 bp, Artificial Sequence
  Description of Artificial Sequence: Synthetic probe
tagaagggaaaaaagatctgcttcagcttcccgatatccgacggtagtgtctactttcaactacgtttta

SEQ ID NO: 2605 - DNA, 70 bp, Artificial Sequence
  Description of Artificial Sequence: Synthetic probe
ggctttcagttatggatttcttcagcttcccgatatccgacggtagtgtgcagaaggctggggtactaca

SEQ ID NO: 2606 - DNA, 70 bp, Artificial Sequence
  Description of Artificial Sequence: Synthetic probe
aaatctttataatagctgtcttcagcttcccgatatccgacggtagtgttcttaccacaggttttcggaa

SEQ ID NO: 2607 - DNA, 70 bp, Artificial Sequence
  Description of Artificial Sequence: Synthetic probe
tctctcaaatcaaataatcccactacttcagcttcccgatatccgacggtagtgtttctctctgaaggtc

SEQ ID NO: 2608 - DNA, 70 bp, Artificial Sequence
  Description of Artificial Sequence: Synthetic probe
cctgagctcatccctagctgcttcagcttcccgatatccgacggtagtgtgccagactgcaagcacagag

SEQ ID NO: 2609 - DNA, 70 bp, Artificial Sequence
  Description of Artificial Sequence: Synthetic probe
cactaacctacagaggcacttcagcttcccgatatccgacggtagtgttctgcattccagagcaagtcat

SEQ ID NO: 2610 - DNA, 70 bp, Artificial Sequence
  Description of Artificial Sequence: Synthetic probe
tcagctgatctgtgcctcggtcaccttcagcttcccgatatccgacggtagtgtcctgagccgcgcggac

SEQ ID NO: 2611 - DNA, 70 bp, Artificial Sequence
  Description of Artificial Sequence: Synthetic probe
cggcgcggcttcaaaccctccggcacttcagcttcccgatatccgacggtagtgtcccacggtgccgccc

SEQ ID NO: 2612 - DNA, 70 bp, Artificial Sequence
  Description of Artificial Sequence: Synthetic probe
ctgtcactgcgacctcgctccctccttcagcttcccgatatccgacggtagtgtacagcccgcccgcctg

SEQ ID NO: 2613 - DNA, 70 bp, Artificial Sequence
  Description of Artificial Sequence: Synthetic probe
gcagcctgggtccgatcgccttcagcttcccgatatccgacggtagtgtctaggagctccgccgccccag

SEQ ID NO: 2614 - DNA, 70 bp, Artificial Sequence
  Description of Artificial Sequence: Synthetic probe
gcgggacgcaggcggcttcagcttcccgatatccgacggtagtgtgtcagcgctggagcttagaaaaaaa

SEQ ID NO: 2615 - DNA, 70 bp, Artificial Sequence
  Description of Artificial Sequence: Synthetic probe
ggggctgtcatgctggggccttcagcttcccgatatccgacggtagtgtcccttttctccaccgtgaaaa

SEQ ID NO: 2616 - DNA, 70 bp, Artificial Sequence
  Description of Artificial Sequence: Synthetic probe
tgttggcaggacgcaccttggcttcagcttcccgatatccgacggtagtgtaggaggatgctgcagacgt

SEQ ID NO: 2617 - DNA, 70 bp, Artificial Sequence
  Description of Artificial Sequence: Synthetic probe
cagggatgggacctggggccccttcagcttcccgatatccgacggtagtgtccacaccagcagcgtcgag

SEQ ID NO: 2618 - DNA, 70 bp, Artificial Sequence
  Description of Artificial Sequence: Synthetic probe
tatggccccggataggcactgcttcagcttcccgatatccgacggtagtgtaggtcaggtagcggatcac

SEQ ID NO: 2619 - DNA, 70 bp, Artificial Sequence
  Description of Artificial Sequence: Synthetic probe
ttcctttggggggcctggcttcagcttcccgatatccgacggtagtgtgcaaaactcacattgtagttgt

SEQ ID NO: 2620 - DNA, 70 bp, Artificial Sequence
  Description of Artificial Sequence: Synthetic probe
tgcgtcaacctatctggcccagcttcagcttcccgatatccgacggtagtgtgtggaaggcccagctgca

SEQ ID NO: 2621 - DNA, 70 bp, Artificial Sequence
  Description of Artificial Sequence: Synthetic probe
ctcgccaagttctgcgggcttcagcttcccgatatccgacggtagtgtgatttatttggagggtgtggag

SEQ ID NO: 2622 - DNA, 70 bp, Artificial Sequence
  Description of Artificial Sequence: Synthetic probe
caggaggatgctgcagacgtcgcttcagcttcccgatatccgacggtagtgtggtgagggctgcgtgtgt

SEQ ID NO: 2623 - DNA, 70 bp, Artificial Sequence
  Description of Artificial Sequence: Synthetic probe
cccacaccagcagcgtcgagcttcagcttcccgatatccgacggtagtgtgcttgcaaggggccattggc

SEQ ID NO: 2624 - DNA, 70 bp, Artificial Sequence
  Description of Artificial Sequence: Synthetic probe
aaggtcaggtagcggatcaccttcagcttcccgatatccgacggtagtgttggtgtgggcaggtaggagg

SEQ ID NO: 2625 - DNA, 70 bp, Artificial Sequence
  Description of Artificial Sequence: Synthetic probe
tgggtgcctagagggggcgtgcttcagcttcccgatatccgacggtagtgtcccgcagtgtggcgatgag

SEQ ID NO: 2626 - DNA, 70 bp, Artificial Sequence
  Description of Artificial Sequence: Synthetic probe
cagccggtgtggtcatgggagcttcagcttcccgatatccgacggtagtgtaagcgcatgacgctgggca

SEQ ID NO: 2627 - DNA, 70 bp, Artificial Sequence
  Description of Artificial Sequence: Synthetic probe
gaggggcggggccttgccttcagcttcccgatatccgacggtagtgtccaggtagatgacagccacgcag

SEQ ID NO: 2628 - DNA, 70 bp, Artificial Sequence
  Description of Artificial Sequence: Synthetic probe
gctgtgggcacccagatggggcttcagcttcccgatatccgacggtagtgttccagccacagaagcagta

SEQ ID NO: 2629 - DNA, 70 bp, Artificial Sequence
  Description of Artificial Sequence: Synthetic probe
gagggtgtggccacaactcacttcagcttcccgatatccgacggtagtgtcttcacatgatagggcccca

SEQ ID NO: 2630 - DNA, 70 bp, Artificial Sequence
  Description of Artificial Sequence: Synthetic probe
gggttggggcagagggagccttcagcttcccgatatccgacggtagtgttcagggacatcaggggttaga

SEQ ID NO: 2631 - DNA, 70 bp, Artificial Sequence
  Description of Artificial Sequence: Synthetic probe
acccgcagtgtggcgacttcagcttcccgatatccgacggtagtgttgtcaatgacaaggtcacagggtc

SEQ ID NO: 2632 - DNA, 70 bp, Artificial Sequence
  Description of Artificial Sequence: Synthetic probe
gaagcgcatgacgctgggcacttcagcttcccgatatccgacggtagtgtggggtcatctgggggtcaca

SEQ ID NO: 2633 - DNA, 70 bp, Artificial Sequence
  Description of Artificial Sequence: Synthetic probe
ggtagatgacagccacgcagccttcagcttcccgatatccgacggtagtgtggacagactcccagcagtc

SEQ ID NO: 2634 - DNA, 70 bp, Artificial Sequence
  Description of Artificial Sequence: Synthetic probe
atccagccacagaagcagtagccttcagcttcccgatatccgacggtagtgttcaccaaggaccacaggg

SEQ ID NO: 2635 - DNA, 70 bp, Artificial Sequence
  Description of Artificial Sequence: Synthetic probe
cccacatgaatggccgggtcccttcagcttcccgatatccgacggtagtgtgagcgagaacaggcactca

SEQ ID NO: 2636 - DNA, 70 bp, Artificial Sequence
  Description of Artificial Sequence: Synthetic probe
atggctaggagctggcttcagcttcccgatatccgacggtagtgtcgaacgtcacaaacatgtcgtcccc

SEQ ID NO: 2637 - DNA, 70 bp, Artificial Sequence
  Description of Artificial Sequence: Synthetic probe
aaggagtaaaggtagagctgggacttcagcttcccgatatccgacggtagtgtgtccccaagaccccctc

SEQ ID NO: 2638 - DNA, 70 bp, Artificial Sequence
  Description of Artificial Sequence: Synthetic probe
caccatgtagatgaagaggccttcagcttcccgatatccgacggtagtgtcctgggtcttctctgttcac

SEQ ID NO: 2639 - DNA, 70 bp, Artificial Sequence
  Description of Artificial Sequence: Synthetic probe
tgatgagcgcgatgaagacttcagcttcccgatatccgacggtagtgtggtttcatagagtctcccatat

SEQ ID NO: 2640 - DNA, 70 bp, Artificial Sequence
  Description of Artificial Sequence: Synthetic probe
ggggtcaggctggggtcccatgcttcagcttcccgatatccgacggtagtgtgctgcgcctgcatggcgg

SEQ ID NO: 2641 - DNA, 70 bp, Artificial Sequence
  Description of Artificial Sequence: Synthetic probe
aaggcatggccaggaacccttcagcttcccgatatccgacggtagtgtgaagagccacaccaggctgctg

SEQ ID NO: 2642 - DNA, 70 bp, Artificial Sequence
  Description of Artificial Sequence: Synthetic probe
aggggcggcggggtccttcagcttcccgatatccgacggtagtgttgatgaaggagtaaaggtagagctg

SEQ ID NO: 2643 - DNA, 70 bp, Artificial Sequence
  Description of Artificial Sequence: Synthetic probe
catggagagtgagcggaaccttcagcttcccgatatccgacggtagtgtgcaccatgtagatgaagaggc

SEQ ID NO: 2644 - DNA, 70 bp, Artificial Sequence
  Description of Artificial Sequence: Synthetic probe
tgagcgagaacaggcactcacttcagcttcccgatatccgacggtagtgttgatgagcgcgatgaagagg

SEQ ID NO: 2645 - DNA, 70 bp, Artificial Sequence
  Description of Artificial Sequence: Synthetic probe
gtcacaaacatgtcgtccccacttcagcttcccgatatccgacggtagtgtccttgatggtgtcgtaggc

SEQ ID NO: 2646 - DNA, 70 bp, Artificial Sequence
  Description of Artificial Sequence: Synthetic probe
ctgctgcgcctgcatggcgcttcagcttcccgatatccgacggtagtgtagctcagggctgggtgcatgc

SEQ ID NO: 2647 - DNA, 70 bp, Artificial Sequence
  Description of Artificial Sequence: Synthetic probe
agagccacaccaggctgctgccttcagcttcccgatatccgacggtagtgtgactccagggcacccagag

SEQ ID NO: 2648 - DNA, 70 bp, Artificial Sequence
  Description of Artificial Sequence: Synthetic probe
ctccacccgttgttccacagtcttcagcttcccgatatccgacggtagtgtgcgcctgcgccgccgggat

SEQ ID NO: 2649 - DNA, 70 bp, Artificial Sequence
  Description of Artificial Sequence: Synthetic probe
cgggcctttgcacttgctgggcttcagcttcccgatatccgacggtagtgtgtaggcctgcagctcgctc

SEQ ID NO: 2650 - DNA, 70 bp, Artificial Sequence
  Description of Artificial Sequence: Synthetic probe
agcagagaaggctgcaggcccttcagcttcccgatatccgacggtagtgtaattcaccagcagcgaatgc

SEQ ID NO: 2651 - DNA, 70 bp, Artificial Sequence
  Description of Artificial Sequence: Synthetic probe
ccatatctgcatcgcttcccacccttcagcttcccgatatccgacggtagtgtgggctgtcctggcactg

SEQ ID NO: 2652 - DNA, 70 bp, Artificial Sequence
  Description of Artificial Sequence: Synthetic probe
ccttgaagtccgccctcccctcccttcagcttcccgatatccgacggtagtgtcccgcggcggaacttgc

SEQ ID NO: 2653 - DNA, 70 bp, Artificial Sequence
  Description of Artificial Sequence: Synthetic probe
gaaagtggctcccaacctccacttcagcttcccgatatccgacggtagtgtgcagagaaggctgcaggcc

SEQ ID NO: 2654 - DNA, 70 bp, Artificial Sequence
  Description of Artificial Sequence: Synthetic probe
ggagagaagccgggaggctcacttcagcttcccgatatccgacggtagtgtcccgggactcgaaccttcc

SEQ ID NO: 2655 - DNA, 70 bp, Artificial Sequence
  Description of Artificial Sequence: Synthetic probe
tgcgcctgcgccgccgggatgcttcagcttcccgatatccgacggtagtgttaacctccaatctgaatgt

SEQ ID NO: 2656 - DNA, 70 bp, Artificial Sequence
  Description of Artificial Sequence: Synthetic probe
tgtaggcctgcagctcgctctccttcagcttcccgatatccgacggtagtgtgctcgctcccctttcccc

SEQ ID NO: 2657 - DNA, 70 bp, Artificial Sequence
  Description of Artificial Sequence: Synthetic probe
gtggggctgtcctggcactgtcttcagcttcccgatatccgacggtagtgtgggaagaggggcgtcagtt

SEQ ID NO: 2658 - DNA, 70 bp, Artificial Sequence
  Description of Artificial Sequence: Synthetic probe
gctcccgcggcggaacttgccttcagcttcccgatatccgacggtagtgtcgaggggtccctggaggaag

SEQ ID NO: 2659 - DNA, 70 bp, Artificial Sequence
  Description of Artificial Sequence: Synthetic probe
gctgcaggccgagccgctccttcagcttcccgatatccgacggtagtgtgcagcgaatgctcctccgagg

SEQ ID NO: 2660 - DNA, 70 bp, Artificial Sequence
  Description of Artificial Sequence: Synthetic probe
cgaaccttccgcagcagccttcagcttcccgatatccgacggtagtgtggcagtcaggtcgaatcaattc

SEQ ID NO: 2661 - DNA, 70 bp, Artificial Sequence
  Description of Artificial Sequence: Synthetic probe
atctgaatgtgccagacccgggacttcagcttcccgatatccgacggtagtgttccagggcctacggtcc

SEQ ID NO: 2662 - DNA, 70 bp, Artificial Sequence
  Description of Artificial Sequence: Synthetic probe
ccctttccccattcccttcagcttcccgatatccgacggtagtgtaataagcggggtcgggggcgggggt

SEQ ID NO: 2663 - DNA, 70 bp, Artificial Sequence
  Description of Artificial Sequence: Synthetic probe
ggcgtcagttttctctggctcttcagcttcccgatatccgacggtagtgtaaaagcaaaccctacaaata

SEQ ID NO: 2664 - DNA, 70 bp, Artificial Sequence
  Description of Artificial Sequence: Synthetic probe
ctggaggaaggaagcagggaagagcttcagcttcccgatatccgacggtagtgtcgcgacagggagccga

SEQ ID NO: 2665 - DNA, 70 bp, Artificial Sequence
  Description of Artificial Sequence: Synthetic probe
cagcgaatgctcctccgagggcttcagcttcccgatatccgacggtagtgtgacacgaaaggtccaggcc

SEQ ID NO: 2666 - DNA, 70 bp, Artificial Sequence
  Description of Artificial Sequence: Synthetic probe
gtctaaagaaaaccagaaaaccttcagcttcccgatatccgacggtagtgtggtcagaagccgctcggtc

SEQ ID NO: 2667 - DNA, 70 bp, Artificial Sequence
  Description of Artificial Sequence: Synthetic probe
tcctgccaaggaagagctctgagcttcagcttcccgatatccgacggtagtgttgggtcccatacccggg

SEQ ID NO: 2668 - DNA, 70 bp, Artificial Sequence
  Description of Artificial Sequence: Synthetic probe
ctcatgaaaaagtatttgagacgaccttcagcttcccgatatccgacggtagtgttcaaggagcacagca

SEQ ID NO: 2669 - DNA, 70 bp, Artificial Sequence
  Description of Artificial Sequence: Synthetic probe
cttggctcgaaacttgtcgccttcagcttcccgatatccgacggtagtgtgccttccaaagtgctgcttt

SEQ ID NO: 2670 - DNA, 70 bp, Artificial Sequence
  Description of Artificial Sequence: Synthetic probe
gcatcagcttgcagggcttgcgcttcagcttcccgatatccgacggtagtgtcctcaagcgatccaccgg

SEQ ID NO: 2671 - DNA, 70 bp, Artificial Sequence
  Description of Artificial Sequence: Synthetic probe
accaccaggatcttgaccactcttcagcttcccgatatccgacggtagtgttggccagactggtcttgaa

SEQ ID NO: 2672 - DNA, 70 bp, Artificial Sequence
  Description of Artificial Sequence: Synthetic probe
acgccctatcttcatgtccccatcttcagcttcccgatatccgacggtagtgtcggaggggccggtgaag

SEQ ID NO: 2673 - DNA, 70 bp, Artificial Sequence
  Description of Artificial Sequence: Synthetic probe
ctttctccaaccaggaaggccttcagcttcccgatatccgacggtagtgtggcgaaggtcttcctcttct

SEQ ID NO: 2674 - DNA, 70 bp, Artificial Sequence
  Description of Artificial Sequence: Synthetic probe
aggcctgggcaactcccttcagcttcccgatatccgacggtagtgtgggactcatgaaaaagtatttgag

SEQ ID NO: 2675 - DNA, 70 bp, Artificial Sequence
  Description of Artificial Sequence: Synthetic probe
gggaataggagagggcactgggcttcagcttcccgatatccgacggtagtgttggctcgaaacttgtcgc

SEQ ID NO: 2676 - DNA, 70 bp, Artificial Sequence
  Description of Artificial Sequence: Synthetic probe
gggtcagaagccgctcggtcttcagcttcccgatatccgacggtagtgtagcatcagcttgcagggcttg

SEQ ID NO: 2677 - DNA, 70 bp, Artificial Sequence
  Description of Artificial Sequence: Synthetic probe
gcctgggtcccatacccggcttcagcttcccgatatccgacggtagtgtgaccaccaggatcttgaccac

SEQ ID NO: 2678 - DNA, 70 bp, Artificial Sequence
  Description of Artificial Sequence: Synthetic probe
tgtcggaggggccggtgaagcttcagcttcccgatatccgacggtagtgtcttggctggcctcacctgca

SEQ ID NO: 2679 - DNA, 70 bp, Artificial Sequence
  Description of Artificial Sequence: Synthetic probe
ggcgaaggtcttcctcttctgggcttcagcttcccgatatccgacggtagtgttggccttcagctggggc

SEQ ID NO: 2680 - DNA, 70 bp, Artificial Sequence
  Description of Artificial Sequence: Synthetic probe
gggcagggccctgctaaccttcagcttcccgatatccgacggtagtgttcacagccagctgattactgag

SEQ ID NO: 2681 - DNA, 70 bp, Artificial Sequence
  Description of Artificial Sequence: Synthetic probe
ggccctgcagatgtccactgggcttcagcttcccgatatccgacggtagtgttggtgttctcttcccgga

SEQ ID NO: 2682 - DNA, 70 bp, Artificial Sequence
  Description of Artificial Sequence: Synthetic probe
ctgctcccgcgtgtaggctgccttcagcttcccgatatccgacggtagtgtgctctctgcagcccaccca

SEQ ID NO: 2683 - DNA, 70 bp, Artificial Sequence
  Description of Artificial Sequence: Synthetic probe
cagcatggaagatggcctggtacttcagcttcccgatatccgacggtagtgtggggagggcctgtgagtc

SEQ ID NO: 2684 - DNA, 70 bp, Artificial Sequence
  Description of Artificial Sequence: Synthetic probe
acaggccctggaagaggacagcttcagcttcccgatatccgacggtagtgtcagcaggaagaggtgtcgg

SEQ ID NO: 2685 - DNA, 70 bp, Artificial Sequence
  Description of Artificial Sequence: Synthetic probe
ggttggggtgtatctccctcaggcttcagcttcccgatatccgacggtagtgttcatccgctccgtccga

SEQ ID NO: 2686 - DNA, 70 bp, Artificial Sequence
  Description of Artificial Sequence: Synthetic probe
tagaggttggcatggctaggatggcttcagcttcccgatatccgacggtagtgttcccgcgtgtaggctg

SEQ ID NO: 2687 - DNA, 70 bp, Artificial Sequence
  Description of Artificial Sequence: Synthetic probe
acaggatgagctggggagaggcttcagcttcccgatatccgacggtagtgtagcatggaagatggcctgg

SEQ ID NO: 2688 - DNA, 70 bp, Artificial Sequence
  Description of Artificial Sequence: Synthetic probe
acagccagctgattactgagcccaacttcagcttcccgatatccgacggtagtgtgcccaccagcacctg

SEQ ID NO: 2689 - DNA, 70 bp, Artificial Sequence
  Description of Artificial Sequence: Synthetic probe
gatggtgttctcttcccggaatgtcttcagcttcccgatatccgacggtagtgtacctgcctgcccacca

SEQ ID NO: 2690 - DNA, 70 bp, Artificial Sequence
  Description of Artificial Sequence: Synthetic probe
ccagcaggaagaggtgtcggaagcttcagcttcccgatatccgacggtagtgtccaactgcacctgcccg

SEQ ID NO: 2691 - DNA, 70 bp, Artificial Sequence
  Description of Artificial Sequence: Synthetic probe
gtgtcatccgctccgtccgagtagcttcagcttcccgatatccgacggtagtgtgcccgcccaccagcac

SEQ ID NO: 2692 - DNA, 70 bp, Artificial Sequence
  Description of Artificial Sequence: Synthetic probe
cctgcctgcccaccagcacctcttcagcttcccgatatccgacggtagtgtcggcccagtgacacgtcag

SEQ ID NO: 2693 - DNA, 70 bp, Artificial Sequence
  Description of Artificial Sequence: Synthetic probe
aactgcacctgcccgcccaccttcagcttcccgatatccgacggtagtgtcacccccaccacggacatac

SEQ ID NO: 2694 - DNA, 70 bp, Artificial Sequence
  Description of Artificial Sequence: Synthetic probe
cgttggccgggtccacgtgcttcagcttcccgatatccgacggtagtgtcctcagcctcccaaagtgctg

SEQ ID NO: 2695 - DNA, 70 bp, Artificial Sequence
  Description of Artificial Sequence: Synthetic probe
accatcggatcaatgtcaaatgtcttcagcttcccgatatccgacggtagtgttggcctcaagcaatcct

SEQ ID NO: 2696 - DNA, 70 bp, Artificial Sequence
  Description of Artificial Sequence: Synthetic probe
cccgcccaccagcacctgcttcagcttcccgatatccgacggtagtgtcaagccctgagccattggtcca

SEQ ID NO: 2697 - DNA, 70 bp, Artificial Sequence
  Description of Artificial Sequence: Synthetic probe
tctgcagcccacccacttcagcttcccgatatccgacggtagtgtcctcggtggtagtaccgctggcaga

SEQ ID NO: 2698 - DNA, 70 bp, Artificial Sequence
  Description of Artificial Sequence: Synthetic probe
gagggcctgtgagtccggcccttcagcttcccgatatccgacggtagtgtcgttggccgggtccacgtgg

SEQ ID NO: 2699 - DNA, 70 bp, Artificial Sequence
  Description of Artificial Sequence: Synthetic probe
gccaggtactgtgggcacttcagcttcccgatatccgacggtagtgtaccaccatcggatcaatgtcaaa

SEQ ID NO: 2700 - DNA, 70 bp, Artificial Sequence
  Description of Artificial Sequence: Synthetic probe
ccggcccagtgacacgtcagcttcagcttcccgatatccgacggtagtgttcgtcctgcccactcaccag

SEQ ID NO: 2701 - DNA, 70 bp, Artificial Sequence
  Description of Artificial Sequence: Synthetic probe
cacccccaccacggacatacgcttcagcttcccgatatccgacggtagtgtgctcaggctcccaacagtg

SEQ ID NO: 2702 - DNA, 70 bp, Artificial Sequence
  Description of Artificial Sequence: Synthetic probe
agccctgagccattggtccttcagcttcccgatatccgacggtagtgtgccacagctgttgattttaatc

SEQ ID NO: 2703 - DNA, 70 bp, Artificial Sequence
  Description of Artificial Sequence: Synthetic probe
gtggtagtaccgctggcagagagccttcagcttcccgatatccgacggtagtgtgcgtgagccaccgtgc

SEQ ID NO: 2704 - DNA, 70 bp, Artificial Sequence
  Description of Artificial Sequence: Synthetic probe
tgggcctgcggatgttttaccttcagcttcccgatatccgacggtagtgtggggatccacctggatgcag

SEQ ID NO: 2705 - DNA, 70 bp, Artificial Sequence
  Description of Artificial Sequence: Synthetic probe
tcattcctacaggcctggcactctccttcagcttcccgatatccgacggtagtgtgggcggagggggccg

SEQ ID NO: 2706 - DNA, 70 bp, Artificial Sequence
  Description of Artificial Sequence: Synthetic probe
ttccctgtgcttccccaggcttcagcttcccgatatccgacggtagtgttgctttccaagagggtgagat

SEQ ID NO: 2707 - DNA, 70 bp, Artificial Sequence
  Description of Artificial Sequence: Synthetic probe
ctccccagagtccccagtggcttcagcttcccgatatccgacggtagtgtgcgtgaggttcttgtaactg

SEQ ID NO: 2708 - DNA, 70 bp, Artificial Sequence
  Description of Artificial Sequence: Synthetic probe
agggggccggggaggccttcagcttcccgatatccgacggtagtgtagtgagcaggcagtacttgtggaa

SEQ ID NO: 2709 - DNA, 70 bp, Artificial Sequence
  Description of Artificial Sequence: Synthetic probe
ggacagggagtcagggaagggcccttcagcttcccgatatccgacggtagtgtcaccctgggcccccctc

SEQ ID NO: 2710 - DNA, 70 bp, Artificial Sequence
  Description of Artificial Sequence: Synthetic probe
ggggatccacctggatgcagtcttcagcttcccgatatccgacggtagtgttgagagtgcctagtgtgct

SEQ ID NO: 2711 - DNA, 70 bp, Artificial Sequence
  Description of Artificial Sequence: Synthetic probe
ctggggggcggaggggcttcagcttcccgatatccgacggtagtgtgtccccaccttagggaagtagttg

SEQ ID NO: 2712 - DNA, 70 bp, Artificial Sequence
  Description of Artificial Sequence: Synthetic probe
gctttccaagagggtgagatcgtcgcttcagcttcccgatatccgacggtagtgtcgggcgggggggccc

SEQ ID NO: 2713 - DNA, 70 bp, Artificial Sequence
  Description of Artificial Sequence: Synthetic probe
gcgtgaggttcttgtaactggacttcagcttcccgatatccgacggtagtgtggaagtgctcacccagca

SEQ ID NO: 2714 - DNA, 70 bp, Artificial Sequence
  Description of Artificial Sequence: Synthetic probe
gggcgggggggccctcttcagcttcccgatatccgacggtagtgtggaagtggatggtgacattgaccag

SEQ ID NO: 2715 - DNA, 70 bp, Artificial Sequence
  Description of Artificial Sequence: Synthetic probe
gtgctcacccagcaggcacttcagcttcccgatatccgacggtagtgttggaggttaatggtcttcagcc

SEQ ID NO: 2716 - DNA, 70 bp, Artificial Sequence
  Description of Artificial Sequence: Synthetic probe
gctgactctgcagctggccttcagcttcccgatatccgacggtagtgtcgggatctcattattgatgagg

SEQ ID NO: 2717 - DNA, 70 bp, Artificial Sequence
  Description of Artificial Sequence: Synthetic probe
caagtgccagcgtcccctgcttcagcttcccgatatccgacggtagtgtcaggacgctgaaggtatagca

SEQ ID NO: 2718 - DNA, 70 bp, Artificial Sequence
  Description of Artificial Sequence: Synthetic probe
ggcgtcttcgggtcccttccggcttcagcttcccgatatccgacggtagtgtgtgggttcccggggggcc

SEQ ID NO: 2719 - DNA, 70 bp, Artificial Sequence
  Description of Artificial Sequence: Synthetic probe
gcaggaggctcgggtgagggcttcagcttcccgatatccgacggtagtgtgtccctgccctggaactcag

SEQ ID NO: 2720 - DNA, 70 bp, Artificial Sequence
  Description of Artificial Sequence: Synthetic probe
tggatggtgacattgaccagccttcagcttcccgatatccgacggtagtgtgctcccaagacactccctg

SEQ ID NO: 2721 - DNA, 70 bp, Artificial Sequence
  Description of Artificial Sequence: Synthetic probe
gaggttaatggtcttcagccggacttcagcttcccgatatccgacggtagtgtccgcacgcttgcccttg

SEQ ID NO: 2722 - DNA, 70 bp, Artificial Sequence
  Description of Artificial Sequence: Synthetic probe
ggatctcattattgatgaggctctgcttcagcttcccgatatccgacggtagtgtccccgggctccctcc

SEQ ID NO: 2723 - DNA, 70 bp, Artificial Sequence
  Description of Artificial Sequence: Synthetic probe
ctcccaagacactccctgaccttcagcttcccgatatccgacggtagtgttgtgtgctttgttgtcaaac

SEQ ID NO: 2724 - DNA, 70 bp, Artificial Sequence
  Description of Artificial Sequence: Synthetic probe
cccgcacgcttgcccttggcttcagcttcccgatatccgacggtagtgtctccaggctgatggggatccg

SEQ ID NO: 2725 - DNA, 70 bp, Artificial Sequence
  Description of Artificial Sequence: Synthetic probe
agaccccgggctccctcccttcagcttcccgatatccgacggtagtgtttacactcctggatgtgggcct

SEQ ID NO: 2726 - DNA, 70 bp, Artificial Sequence
  Description of Artificial Sequence: Synthetic probe
aggtccacatgacaggtggcccttcagcttcccgatatccgacggtagtgtgtgctggaagacactgggg

SEQ ID NO: 2727 - DNA, 70 bp, Artificial Sequence
  Description of Artificial Sequence: Synthetic probe
taaaccttggcagccccaagcccttcagcttcccgatatccgacggtagtgttggtctggggctcagggg

SEQ ID NO: 2728 - DNA, 70 bp, Artificial Sequence
  Description of Artificial Sequence: Synthetic probe
ctgtgggggccagttgggggcagcttcagcttcccgatatccgacggtagtgtcaggccagggcccctgg

SEQ ID NO: 2729 - DNA, 70 bp, Artificial Sequence
  Description of Artificial Sequence: Synthetic probe
tgtgtgctttgttgtcaaaccttcagcttcccgatatccgacggtagtgtctgatctggggcttggggaa

SEQ ID NO: 2730 - DNA, 70 bp, Artificial Sequence
  Description of Artificial Sequence: Synthetic probe
tccaggctgatggggatccgcccttcagcttcccgatatccgacggtagtgtgaggtcacggcccccagg

SEQ ID NO: 2731 - DNA, 70 bp, Artificial Sequence
  Description of Artificial Sequence: Synthetic probe
acactcctggatgtgggcctcttcagcttcccgatatccgacggtagtgttgatctgaggctcagcggat

SEQ ID NO: 2732 - DNA, 70 bp, Artificial Sequence
  Description of Artificial Sequence: Synthetic probe
gtgggctcagggcttgcttggcttcagcttcccgatatccgacggtagtgtccacgtcaaacaggagccg

SEQ ID NO: 2733 - DNA, 70 bp, Artificial Sequence
  Description of Artificial Sequence: Synthetic probe
ctgcacggctggttttggttggcttcagcttcccgatatccgacggtagtgtacagggagcaggtgagga

SEQ ID NO: 2734 - DNA, 70 bp, Artificial Sequence
  Description of Artificial Sequence: Synthetic probe
caggccaggctggagacctaggcttcagcttcccgatatccgacggtagtgtagtgagcgggcgcagagg

SEQ ID NO: 2735 - DNA, 70 bp, Artificial Sequence
  Description of Artificial Sequence: Synthetic probe
agccttgggaggctagcattggtcttcagcttcccgatatccgacggtagtgtttctgcagcaggaagcc

SEQ ID NO: 2736 - DNA, 70 bp, Artificial Sequence
  Description of Artificial Sequence: Synthetic probe
gcgggtagggccaaggatggcttcagcttcccgatatccgacggtagtgtccagcacacatgacgcagaa

SEQ ID NO: 2737 - DNA, 70 bp, Artificial Sequence
  Description of Artificial Sequence: Synthetic probe
tgttgtctcctgcggggagggcagcttcagcttcccgatatccgacggtagtgtcagggccaggcgggga

SEQ ID NO: 2738 - DNA, 70 bp, Artificial Sequence
  Description of Artificial Sequence: Synthetic probe
accacgtcaaacaggagccggcttcagcttcccgatatccgacggtagtgtaccctcaaagccctggctt

SEQ ID NO: 2739 - DNA, 70 bp, Artificial Sequence
  Description of Artificial Sequence: Synthetic probe
ggacagggagcaggtgaggatgcttcagcttcccgatatccgacggtagtgtggtgagggcctgaccagg

SEQ ID NO: 2740 - DNA, 70 bp, Artificial Sequence
  Description of Artificial Sequence: Synthetic probe
ggagtgagcgggcgcagacttcagcttcccgatatccgacggtagtgtccccacaaactcctgcagaagg

SEQ ID NO: 2741 - DNA, 70 bp, Artificial Sequence
  Description of Artificial Sequence: Synthetic probe
ctgcagcaggaagcccttcagcttcccgatatccgacggtagtgtcgtccccgctgccgccacatgaacc

SEQ ID NO: 2742 - DNA, 70 bp, Artificial Sequence
  Description of Artificial Sequence: Synthetic probe
acacatgacgcagaagcctcacttcagcttcccgatatccgacggtagtgtctcccacaggctgatgacc

SEQ ID NO: 2743 - DNA, 70 bp, Artificial Sequence
  Description of Artificial Sequence: Synthetic probe
tcatgatggtgcccgagatggtgacttcagcttcccgatatccgacggtagtgtgggtgggagctgcgtc

SEQ ID NO: 2744 - DNA, 70 bp, Artificial Sequence
  Description of Artificial Sequence: Synthetic probe
agggccaggcggggacttcagcttcccgatatccgacggtagtgtggatgtaccagccattgacaaattc

SEQ ID NO: 2745 - DNA, 70 bp, Artificial Sequence
  Description of Artificial Sequence: Synthetic probe
tcaaagccctggcttttatcgccccttcagcttcccgatatccgacggtagtgttcgctggtgacgagca

SEQ ID NO: 2746 - DNA, 70 bp, Artificial Sequence
  Description of Artificial Sequence: Synthetic probe
gagggcctgaccaggcacacttcagcttcccgatatccgacggtagtgtttcatgatggtgcccgagatg

SEQ ID NO: 2747 - DNA, 70 bp, Artificial Sequence
  Description of Artificial Sequence: Synthetic probe
aactcctgcagaaggcaggcgcttcagcttcccgatatccgacggtagtgtgcaccttggcctcgatgcc

SEQ ID NO: 2748 - DNA, 70 bp, Artificial Sequence
  Description of Artificial Sequence: Synthetic probe
ccgctgccgccacatgaaccccttcagcttcccgatatccgacggtagtgtctggggcccagggtgttgg

SEQ ID NO: 2749 - DNA, 70 bp, Artificial Sequence
  Description of Artificial Sequence: Synthetic probe
gctcccacaggctgatgaccccttcagcttcccgatatccgacggtagtgttaggcactgacagcaggga

SEQ ID NO: 2750 - DNA, 70 bp, Artificial Sequence
  Description of Artificial Sequence: Synthetic probe
taccagccattgacaaattccacttcagcttcccgatatccgacggtagtgtcctgggggaggatatggc

SEQ ID NO: 2751 - DNA, 70 bp, Artificial Sequence
  Description of Artificial Sequence: Synthetic probe
cacatcgctggtgacgagcaggcttcagcttcccgatatccgacggtagtgtctggcccagcccttcctt

SEQ ID NO: 2752 - DNA, 70 bp, Artificial Sequence
  Description of Artificial Sequence: Synthetic probe
ggcccaagcagatttcacttcagcttcccgatatccgacggtagtgtagttaaggttaattattacacag

SEQ ID NO: 2753 - DNA, 70 bp, Artificial Sequence
  Description of Artificial Sequence: Synthetic probe
gcccaggatgatccccttcagcttcccgatatccgacggtagtgtagatactaacctttcaatcataaac

SEQ ID NO: 2754 - DNA, 70 bp, Artificial Sequence
  Description of Artificial Sequence: Synthetic probe
catgtccagagataaaactgtcttcagcttcccgatatccgacggtagtgtttagcattattcatctctg

SEQ ID NO: 2755 - DNA, 70 bp, Artificial Sequence
  Description of Artificial Sequence: Synthetic probe
acatcttctgtcaaagcttcagcttcccgatatccgacggtagtgtggtatattttcaatgtaataataa

SEQ ID NO: 2756 - DNA, 70 bp, Artificial Sequence
  Description of Artificial Sequence: Synthetic probe
agctgatctgaaataagaaaagcttcagcttcccgatatccgacggtagtgtggctcgctctaaaggtca

SEQ ID NO: 2757 - DNA, 70 bp, Artificial Sequence
  Description of Artificial Sequence: Synthetic probe
gaaagaaacatttgacatgttccttcagcttcccgatatccgacggtagtgtagcaaccttaccatcatc

SEQ ID NO: 2758 - DNA, 70 bp, Artificial Sequence
  Description of Artificial Sequence: Synthetic probe
aatctgttataggtaaacacacttcagcttcccgatatccgacggtagtgtgcccaagcagatttcaaag

SEQ ID NO: 2759 - DNA, 70 bp, Artificial Sequence
  Description of Artificial Sequence: Synthetic probe
tcacagcacagaaaagccttcttcagcttcccgatatccgacggtagtgtgcccaggatgatccctgaag

SEQ ID NO: 2760 - DNA, 70 bp, Artificial Sequence
  Description of Artificial Sequence: Synthetic probe
cttcatagttaattacctgtgccttcagcttcccgatatccgacggtagtgttgtccagagataaaactg

SEQ ID NO: 2761 - DNA, 70 bp, Artificial Sequence
  Description of Artificial Sequence: Synthetic probe
cagagctactattcttaaaggcttcagcttcccgatatccgacggtagtgtcactaaaactcacttacag

SEQ ID NO: 2762 - DNA, 70 bp, Artificial Sequence
  Description of Artificial Sequence: Synthetic probe
gtcaaattgagactgtccgcttcagcttcccgatatccgacggtagtgtttaattctctcttctctagct

SEQ ID NO: 2763 - DNA, 70 bp, Artificial Sequence
  Description of Artificial Sequence: Synthetic probe
tcacttttcatgcaacttcagcttcccgatatccgacggtagtgtgcattgtaaaatatggactttgatt

SEQ ID NO: 2764 - DNA, 70 bp, Artificial Sequence
  Description of Artificial Sequence: Synthetic probe
tctctttttaactaatatcatccttcagcttcccgatatccgacggtagtgttccagtatttcaatgtgt

SEQ ID NO: 2765 - DNA, 70 bp, Artificial Sequence
  Description of Artificial Sequence: Synthetic probe
taaggaaaaaatacgttaaagggccttcagcttcccgatatccgacggtagtgtaaggcaggaagaggat

SEQ ID NO: 2766 - DNA, 70 bp, Artificial Sequence
  Description of Artificial Sequence: Synthetic probe
ttgctcccactggggccttcagcttcccgatatccgacggtagtgtatgtagccatatctttgtcatatt

SEQ ID NO: 2767 - DNA, 70 bp, Artificial Sequence
  Description of Artificial Sequence: Synthetic probe
gatatagccttgataactgggccttcagcttcccgatatccgacggtagtgtaatggaaatatgagattt

SEQ ID NO: 2768 - DNA, 70 bp, Artificial Sequence
  Description of Artificial Sequence: Synthetic probe
gtaaaatatggactttgacttcagcttcccgatatccgacggtagtgtacacaaacaagagcaaaatatg

SEQ ID NO: 2769 - DNA, 70 bp, Artificial Sequence
  Description of Artificial Sequence: Synthetic probe
catccagtatttcaatgtgtcttcagcttcccgatatccgacggtagtgtaacttacatcttctatgtcc

SEQ ID NO: 2770 - DNA, 70 bp, Artificial Sequence
  Description of Artificial Sequence: Synthetic probe
ggcaaaggcaggaagacttcagcttcccgatatccgacggtagtgttgtccagagctactattcttaaag

SEQ ID NO: 2771 - DNA, 70 bp, Artificial Sequence
  Description of Artificial Sequence: Synthetic probe
ttgtcttgttcagcctaaaacttcagcttcccgatatccgacggtagtgtgtcaaattgagactgtccga

SEQ ID NO: 2772 - DNA, 70 bp, Artificial Sequence
  Description of Artificial Sequence: Synthetic probe
aagaaaagaaaatatttagaaagtcttcagcttcccgatatccgacggtagtgttcccactggggcagat

SEQ ID NO: 2773 - DNA, 70 bp, Artificial Sequence
  Description of Artificial Sequence: Synthetic probe
tatgtcgtgctatcttttcttcagcttcccgatatccgacggtagtgtaggatatagccttgataactgg

SEQ ID NO: 2774 - DNA, 70 bp, Artificial Sequence
  Description of Artificial Sequence: Synthetic probe
ggtgtaagtttgctgttctcttcagcttcccgatatccgacggtagtgttcttctctctggtattgaaaa

SEQ ID NO: 2775 - DNA, 70 bp, Artificial Sequence
  Description of Artificial Sequence: Synthetic probe
tccactggttgaagtaaggtgcttcagcttcccgatatccgacggtagtgtatttttcccccaagtcatt

SEQ ID NO: 2776 - DNA, 70 bp, Artificial Sequence
  Description of Artificial Sequence: Synthetic probe
aacgataaaagatatttaactagacttcagcttcccgatatccgacggtagtgtaaaggtgaagctctgg

SEQ ID NO: 2777 - DNA, 70 bp, Artificial Sequence
  Description of Artificial Sequence: Synthetic probe
agcgagtaataccagtctgtcttcagcttcccgatatccgacggtagtgttttcagttttaaccagacat

SEQ ID NO: 2778 - DNA, 70 bp, Artificial Sequence
  Description of Artificial Sequence: Synthetic probe
ggtgaagactgaggtgtcttcagcttcccgatatccgacggtagtgtctttcagttccatacaaacatac

SEQ ID NO: 2779 - DNA, 70 bp, Artificial Sequence
  Description of Artificial Sequence: Synthetic probe
agaaaaaggtgaagctccttcagcttcccgatatccgacggtagtgtacatacattcatacatacatatg

SEQ ID NO: 2780 - DNA, 70 bp, Artificial Sequence
  Description of Artificial Sequence: Synthetic probe
ttgtctttgaaaaaaaatgacacttcagcttcccgatatccgacggtagtgtacacaaaagctctttacc

SEQ ID NO: 2781 - DNA, 70 bp, Artificial Sequence
  Description of Artificial Sequence: Synthetic probe
tttcaaacgttgaataaatcttcagcttcccgatatccgacggtagtgtaggtgtaagtttgctgttctt

SEQ ID NO: 2782 - DNA, 70 bp, Artificial Sequence
  Description of Artificial Sequence: Synthetic probe
gctattagttcattacctagacttcagcttcccgatatccgacggtagtgtccactggttgaagtaaggt

SEQ ID NO: 2783 - DNA, 70 bp, Artificial Sequence
  Description of Artificial Sequence: Synthetic probe
aatgtttgaaatttatagcaacttcagcttcccgatatccgacggtagtgtgcgagtaataccagtctgt

SEQ ID NO: 2784 - DNA, 70 bp, Artificial Sequence
  Description of Artificial Sequence: Synthetic probe
ccacgtgaaagtattaagaacttcagcttcccgatatccgacggtagtgtggtgaagactgaggtgtagt

SEQ ID NO: 2785 - DNA, 70 bp, Artificial Sequence
  Description of Artificial Sequence: Synthetic probe
tgtatgacactgtccccagcttcagcttcccgatatccgacggtagtgtacagaaatttaaagctattta

SEQ ID NO: 2786 - DNA, 70 bp, Artificial Sequence
  Description of Artificial Sequence: Synthetic probe
tgtctgtataaacatacacacttcagcttcccgatatccgacggtagtgtattatgctatacaataagtg

SEQ ID NO: 2787 - DNA, 70 bp, Artificial Sequence
  Description of Artificial Sequence: Synthetic probe
aatttgaaagggtgcaaaaatcttcagcttcccgatatccgacggtagtgtattgacgatgactggctca

SEQ ID NO: 2788 - DNA, 70 bp, Artificial Sequence
  Description of Artificial Sequence: Synthetic probe
tgttgataaaaggacgtaacttcagcttcccgatatccgacggtagtgtcttgtacaccatcaaatgctg

SEQ ID NO: 2789 - DNA, 70 bp, Artificial Sequence
  Description of Artificial Sequence: Synthetic probe
ggatatttcagggaaggtcttcagcttcccgatatccgacggtagtgtaatcaatttctgtttcttaagt

SEQ ID NO: 2790 - DNA, 70 bp, Artificial Sequence
  Description of Artificial Sequence: Synthetic probe
ttatcatttgcatccatcacttcagcttcccgatatccgacggtagtgttcttcatgagcatatcgtata

SEQ ID NO: 2791 - DNA, 70 bp, Artificial Sequence
  Description of Artificial Sequence: Synthetic probe
tattgacgatgactggccttcagcttcccgatatccgacggtagtgtgcacatgtaaataacagctttga

SEQ ID NO: 2792 - DNA, 70 bp, Artificial Sequence
  Description of Artificial Sequence: Synthetic probe
ttgtacaccatcaaatgctgttatccttcagcttcccgatatccgacggtagtgtatattatgtgagtag

SEQ ID NO: 2793 - DNA, 70 bp, Artificial Sequence
  Description of Artificial Sequence: Synthetic probe
tttgggaggagaaaaatacacttcttcagcttcccgatatccgacggtagtgtatgacactgtccccagg

SEQ ID NO: 2794 - DNA, 70 bp, Artificial Sequence
  Description of Artificial Sequence: Synthetic probe
tagagatgttctgcaaacttcagcttcccgatatccgacggtagtgttcatgtctgtataaacatacaca

SEQ ID NO: 2795 - DNA, 70 bp, Artificial Sequence
  Description of Artificial Sequence: Synthetic probe
gtacagagtttgctcttacacttcagcttcccgatatccgacggtagtgtggatatttcagggaaggttg

SEQ ID NO: 2796 - DNA, 70 bp, Artificial Sequence
  Description of Artificial Sequence: Synthetic probe
acaagtttcttacaggtcttcagcttcccgatatccgacggtagtgtgtgttatcatttgcatccatcac

SEQ ID NO: 2797 - DNA, 70 bp, Artificial Sequence
  Description of Artificial Sequence: Synthetic probe
ggaggagcattatccgctcttcagcttcccgatatccgacggtagtgtcctgagaatctggtctctctga

SEQ ID NO: 2798 - DNA, 70 bp, Artificial Sequence
  Description of Artificial Sequence: Synthetic probe
ccgtgagtgcgtaagtcttcagcttcccgatatccgacggtagtgttttctgatctaatttagatgttta

SEQ ID NO: 2799 - DNA, 70 bp, Artificial Sequence
  Description of Artificial Sequence: Synthetic probe
ccaacaaaagaagcttgcttcttcagcttcccgatatccgacggtagtgttgatgaagtctccctgagcc

SEQ ID NO: 2800 - DNA, 70 bp, Artificial Sequence
  Description of Artificial Sequence: Synthetic probe
gaaaaaaacacaggaaagtcttcagcttcccgatatccgacggtagtgtcaaggatttcatatgtgatct

SEQ ID NO: 2801 - DNA, 70 bp, Artificial Sequence
  Description of Artificial Sequence: Synthetic probe
gacatatatactgttttttgttttcttcagcttcccgatatccgacggtagtgtacccttcgtctgcgtc

SEQ ID NO: 2802 - DNA, 70 bp, Artificial Sequence
  Description of Artificial Sequence: Synthetic probe
tatcatttccacccctggagcttcagcttcccgatatccgacggtagtgttaaaagaatacttgccgcgc

SEQ ID NO: 2803 - DNA, 70 bp, Artificial Sequence
  Description of Artificial Sequence: Synthetic probe
gtgataagccctgttgtcttcagcttcccgatatccgacggtagtgtcttaaatttaattacagggttaa

SEQ ID NO: 2804 - DNA, 70 bp, Artificial Sequence
  Description of Artificial Sequence: Synthetic probe
tgatgaagtctccctgagccttcagcttcccgatatccgacggtagtgtgcccgatgaaaagactgcatt

SEQ ID NO: 2805 - DNA, 70 bp, Artificial Sequence
  Description of Artificial Sequence: Synthetic probe
aaggatttcatatgtgatctcccttcagcttcccgatatccgacggtagtgtatataaattaccttcgct

SEQ ID NO: 2806 - DNA, 70 bp, Artificial Sequence
  Description of Artificial Sequence: Synthetic probe
tttgacccttcgtctgcgtcttcagcttcccgatatccgacggtagtgtaggaggagcattatccgctgc

SEQ ID NO: 2807 - DNA, 70 bp, Artificial Sequence
  Description of Artificial Sequence: Synthetic probe
cagtgagctggaattgaaaacttcagcttcccgatatccgacggtagtgtccgtgagtgcgtaagtccgc

SEQ ID NO: 2808 - DNA, 70 bp, Artificial Sequence
  Description of Artificial Sequence: Synthetic probe
acataaatcctcttgggtctcacttcagcttcccgatatccgacggtagtgttcatttccacccctggag

SEQ ID NO: 2809 - DNA, 70 bp, Artificial Sequence
  Description of Artificial Sequence: Synthetic probe
tttcaccaccatgtcgttcttcagcttcccgatatccgacggtagtgttggtgataagccctgttgtttt

SEQ ID NO: 2810 - DNA, 70 bp, Artificial Sequence
  Description of Artificial Sequence: Synthetic probe
ttaataaaacagcaccaacccttcagcttcccgatatccgacggtagtgttccagatggaattttcattc

SEQ ID NO: 2811 - DNA, 70 bp, Artificial Sequence
  Description of Artificial Sequence: Synthetic probe
ggcttcactaatttcaaggctcttcagcttcccgatatccgacggtagtgtgtggaggcaagcatgtgag

SEQ ID NO: 2812 - DNA, 70 bp, Artificial Sequence
  Description of Artificial Sequence: Synthetic probe
caatcaaaatgaaaggatagaaaaacttcagcttcccgatatccgacggtagtgtacacagtgcagatgg

SEQ ID NO: 2813 - DNA, 70 bp, Artificial Sequence
  Description of Artificial Sequence: Synthetic probe
atcagctgtgggaagcgcttcagcttcccgatatccgacggtagtgtttctccctccatacacaaatata

SEQ ID NO: 2814 - DNA, 70 bp, Artificial Sequence
  Description of Artificial Sequence: Synthetic probe
tttgattatttggtggaagcactcttcagcttcccgatatccgacggtagtgtaaatgccaagcttgtca

SEQ ID NO: 2815 - DNA, 70 bp, Artificial Sequence
  Description of Artificial Sequence: Synthetic probe
aatatacacagtgcagatggcttcagcttcccgatatccgacggtagtgtgaatttatacacacacacac

SEQ ID NO: 2816 - DNA, 70 bp, Artificial Sequence
  Description of Artificial Sequence: Synthetic probe
ctgcagagaaagagaggacttcagcttcccgatatccgacggtagtgtcacacaccaaggaacatacctg

SEQ ID NO: 2817 - DNA, 70 bp, Artificial Sequence
  Description of Artificial Sequence: Synthetic probe
atggttacgaatctgcatcacacttcagcttcccgatatccgacggtagtgtaataaaacagcaccaacc

SEQ ID NO: 2818 - DNA, 70 bp, Artificial Sequence
  Description of Artificial Sequence: Synthetic probe
aatgttagactgcattgttcttcagcttcccgatatccgacggtagtgttggcttcactaatttcaaggc

SEQ ID NO: 2819 - DNA, 70 bp, Artificial Sequence
  Description of Artificial Sequence: Synthetic probe
gttgttgggtttacaggagaacttcagcttcccgatatccgacggtagtgttcagctgtgggaagcgagg

SEQ ID NO: 2820 - DNA, 70 bp, Artificial Sequence
  Description of Artificial Sequence: Synthetic probe
tttccaaattttatgaaaaatcttcagcttcccgatatccgacggtagtgtttgattatttggtggaagc

SEQ ID NO: 2821 - DNA, 70 bp, Artificial Sequence
  Description of Artificial Sequence: Synthetic probe
aaaaactctctgaggatctccattccttcagcttcccgatatccgacggtagtgtttagcattcatagaa

SEQ ID NO: 2822 - DNA, 70 bp, Artificial Sequence
  Description of Artificial Sequence: Synthetic probe
tcaatggcatatgttattgagtcttcagcttcccgatatccgacggtagtgtagggaagtacaactacaa

SEQ ID NO: 2823 - DNA, 70 bp, Artificial Sequence
  Description of Artificial Sequence: Synthetic probe
cctctcgatcagttgcctcttcagcttcccgatatccgacggtagtgtgctgaaagcctctgattagaag

SEQ ID NO: 2824 - DNA, 70 bp, Artificial Sequence
  Description of Artificial Sequence: Synthetic probe
gaaaacataattcaattatcacttcagcttcccgatatccgacggtagtgtttcttactaacagtacgtt

SEQ ID NO: 2825 - DNA, 70 bp, Artificial Sequence
  Description of Artificial Sequence: Synthetic probe
attgatatggcgcccacttcagcttcccgatatccgacggtagtgtctgtacatttttttaaagtaggaa

SEQ ID NO: 2826 - DNA, 70 bp, Artificial Sequence
  Description of Artificial Sequence: Synthetic probe
gagtaatataaaagcttgaaaccttcagcttcccgatatccgacggtagtgtttaacttacgtttctgaa

SEQ ID NO: 2827 - DNA, 70 bp, Artificial Sequence
  Description of Artificial Sequence: Synthetic probe
tagcacagaatgtccatgaccttcagcttcccgatatccgacggtagtgtaaaaactctctgaggatctc

SEQ ID NO: 2828 - DNA, 70 bp, Artificial Sequence
  Description of Artificial Sequence: Synthetic probe
taaagaataaagattaaagcacttcagcttcccgatatccgacggtagtgtcaatggcatatgttattga

SEQ ID NO: 2829 - DNA, 70 bp, Artificial Sequence
  Description of Artificial Sequence: Synthetic probe
ctggcctgccatctgaagctgtgatcttcagcttcccgatatccgacggtagtgtagaaaagagcaacac

SEQ ID NO: 2830 - DNA, 70 bp, Artificial Sequence
  Description of Artificial Sequence: Synthetic probe
gatcagaatgtagcgatcacttcagcttcccgatatccgacggtagtgtagtaattataagaagttgctc

SEQ ID NO: 2831 - DNA, 70 bp, Artificial Sequence
  Description of Artificial Sequence: Synthetic probe
tccctgtccagtgctcttcagcttcccgatatccgacggtagtgtcagatgaaaaacattaattcatgtc

SEQ ID NO: 2832 - DNA, 70 bp, Artificial Sequence
  Description of Artificial Sequence: Synthetic probe
ttagaatccccgtgctcttcagcttcccgatatccgacggtagtgtgtgatacattgtttaagactctct

SEQ ID NO: 2833 - DNA, 70 bp, Artificial Sequence
  Description of Artificial Sequence: Synthetic probe
acaaacaaacaaataagaccttcagcttcccgatatccgacggtagtgttgccttaatactatttttaaa

SEQ ID NO: 2834 - DNA, 70 bp, Artificial Sequence
  Description of Artificial Sequence: Synthetic probe
agatattatgtcacaaggagacttcagcttcccgatatccgacggtagtgttcacagggagcatactcac

SEQ ID NO: 2835 - DNA, 70 bp, Artificial Sequence
  Description of Artificial Sequence: Synthetic probe
tcttagtatagtgaattactttcttcagcttcccgatatccgacggtagtgtggcctgccatctgaagct

SEQ ID NO: 2836 - DNA, 70 bp, Artificial Sequence
  Description of Artificial Sequence: Synthetic probe
tagctttttttcccctctccttcagcttcccgatatccgacggtagtgttgatcagaatgtagcgatcag

SEQ ID NO: 2837 - DNA, 70 bp, Artificial Sequence
  Description of Artificial Sequence: Synthetic probe
cacagcttgagtattttagatgcttcagcttcccgatatccgacggtagtgtcctgtccagtgctttccc

SEQ ID NO: 2838 - DNA, 70 bp, Artificial Sequence
  Description of Artificial Sequence: Synthetic probe
tttacttgacccacaaaggcttcagcttcccgatatccgacggtagtgtggatatgattcattttttaaa

SEQ ID NO: 2839 - DNA, 70 bp, Artificial Sequence
  Description of Artificial Sequence: Synthetic probe
cttcttcttccaccacagacttcagcttcccgatatccgacggtagtgttgaagaatatccagcacagtc

SEQ ID NO: 2840 - DNA, 70 bp, Artificial Sequence
  Description of Artificial Sequence: Synthetic probe
ttccaaaaaataaaaataaacttcagcttcccgatatccgacggtagtgtccactatgtttactgtggca

SEQ ID NO: 2841 - DNA, 70 bp, Artificial Sequence
  Description of Artificial Sequence: Synthetic probe
tcttggcagataaggatcacttcagcttcccgatatccgacggtagtgtaacagattacattagctgagt

SEQ ID NO: 2842 - DNA, 70 bp, Artificial Sequence
  Description of Artificial Sequence: Synthetic probe
ggagcattgtcattgacttcagcttcccgatatccgacggtagtgttcttttgagaattaaaatgtaata

SEQ ID NO: 2843 - DNA, 70 bp, Artificial Sequence
  Description of Artificial Sequence: Synthetic probe
ccactatgtttactgtggcagttcttcagcttcccgatatccgacggtagtgtctctttgaaaaactaca

SEQ ID NO: 2844 - DNA, 70 bp, Artificial Sequence
  Description of Artificial Sequence: Synthetic probe
ggtcttaaagaaaaacacacttcagcttcccgatatccgacggtagtgtagatctatataaatattccac

SEQ ID NO: 2845 - DNA, 70 bp, Artificial Sequence
  Description of Artificial Sequence: Synthetic probe
aaatgtgagaggagctattttcttcagcttcccgatatccgacggtagtgtttacttgacccacaaaggc

SEQ ID NO: 2846 - DNA, 70 bp, Artificial Sequence
  Description of Artificial Sequence: Synthetic probe
tagaattcatttaagtagtcatcttcagcttcccgatatccgacggtagtgttcttcttccaccacagat

SEQ ID NO: 2847 - DNA, 70 bp, Artificial Sequence
  Description of Artificial Sequence: Synthetic probe
ggcatttgtctatctgaaaacttcagcttcccgatatccgacggtagtgttcttggcagataaggatcaa

SEQ ID NO: 2848 - DNA, 70 bp, Artificial Sequence
  Description of Artificial Sequence: Synthetic probe
tcatttttctttctaatcctcttcagcttcccgatatccgacggtagtgtggagcattgtcattgacatc

SEQ ID NO: 2849 - DNA, 70 bp, Artificial Sequence
  Description of Artificial Sequence: Synthetic probe
tagtcccagctggcacttcagcttcccgatatccgacggtagtgtaaaaatttattcattgtttatctga

SEQ ID NO: 2850 - DNA, 70 bp, Artificial Sequence
  Description of Artificial Sequence: Synthetic probe
aacaaggacagtgtatgttgcttcagcttcccgatatccgacggtagtgtaaatccaacttggtatgttg

SEQ ID NO: 2851 - DNA, 70 bp, Artificial Sequence
  Description of Artificial Sequence: Synthetic probe
gtgcacttgaccatttattcccttcagcttcccgatatccgacggtagtgtagagttgaatgacgagggt

SEQ ID NO: 2852 - DNA, 70 bp, Artificial Sequence
  Description of Artificial Sequence: Synthetic probe
tcagggtctgttgcctattacttcagcttcccgatatccgacggtagtgtgctccatctgttgccacaac

SEQ ID NO: 2853 - DNA, 70 bp, Artificial Sequence
  Description of Artificial Sequence: Synthetic probe
aacaaaaaaacaaaaaaattcacttcagcttcccgatatccgacggtagtgttcatagtagtccctgact

SEQ ID NO: 2854 - DNA, 70 bp, Artificial Sequence
  Description of Artificial Sequence: Synthetic probe
aagttttgacgggctactgcttcagcttcccgatatccgacggtagtgttgttaagcttcactgctgtgt

SEQ ID NO: 2855 - DNA, 70 bp, Artificial Sequence
  Description of Artificial Sequence: Synthetic probe
aaggtaacagttaacaaatcttcagcttcccgatatccgacggtagtgtgctcccattggatgtgatacg

SEQ ID NO: 2856 - DNA, 70 bp, Artificial Sequence
  Description of Artificial Sequence: Synthetic probe
atttttctaaccaaaaattcttcagcttcccgatatccgacggtagtgtagattattaaagttacccaaa

SEQ ID NO: 2857 - DNA, 70 bp, Artificial Sequence
  Description of Artificial Sequence: Synthetic probe
ccctctaaggaggaaatgacttcagcttcccgatatccgacggtagtgtagtgcacttgaccatttattc

SEQ ID NO: 2858 - DNA, 70 bp, Artificial Sequence
  Description of Artificial Sequence: Synthetic probe
gtgaacacaggactgttcttcagcttcccgatatccgacggtagtgtttgttacttgctaattttggcac

SEQ ID NO: 2859 - DNA, 70 bp, Artificial Sequence
  Description of Artificial Sequence: Synthetic probe
tgtccaaaaccttgatggccttcagcttcccgatatccgacggtagtgtaccctaatagcaaatctccta

SEQ ID NO: 2860 - DNA, 70 bp, Artificial Sequence
  Description of Artificial Sequence: Synthetic probe
tagagttgaatgacgagggcttcagcttcccgatatccgacggtagtgtaggattcatgtaataaatgct

SEQ ID NO: 2861 - DNA, 70 bp, Artificial Sequence
  Description of Artificial Sequence: Synthetic probe
gctccatctgttgccacacttcagcttcccgatatccgacggtagtgttcccacacacctctatttgaag

SEQ ID NO: 2862 - DNA, 70 bp, Artificial Sequence
  Description of Artificial Sequence: Synthetic probe
gttcatagtagtccctgacttcttcagcttcccgatatccgacggtagtgtagtcccagctggcaaattc

SEQ ID NO: 2863 - DNA, 70 bp, Artificial Sequence
  Description of Artificial Sequence: Synthetic probe
gttaagcttcactgctgtgcttcagcttcccgatatccgacggtagtgtcaacaaggacagtgtatgttg

SEQ ID NO: 2864 - DNA, 70 bp, Artificial Sequence
  Description of Artificial Sequence: Synthetic probe
ctcccattggatgtgataccttcagcttcccgatatccgacggtagtgtggtgaacacaggactgttatc

SEQ ID NO: 2865 - DNA, 70 bp, Artificial Sequence
  Description of Artificial Sequence: Synthetic probe
gattattaaagttacccaaactcttcagcttcccgatatccgacggtagtgttccaaaaccttgatggcc

SEQ ID NO: 2866 - DNA, 70 bp, Artificial Sequence
  Description of Artificial Sequence: Synthetic probe
tacaatcactgtgacagtagccttcagcttcccgatatccgacggtagtgtttccattggaaaatctatg

SEQ ID NO: 2867 - DNA, 70 bp, Artificial Sequence
  Description of Artificial Sequence: Synthetic probe
ccaggtggcattgttccacttcagcttcccgatatccgacggtagtgttgggtctggtaccactgtgtca

SEQ ID NO: 2868 - DNA, 70 bp, Artificial Sequence
  Description of Artificial Sequence: Synthetic probe
agtgacgttaccaaaacttcagcttcccgatatccgacggtagtgttgcctcataatctaaactccttaa

SEQ ID NO: 2869 - DNA, 70 bp, Artificial Sequence
  Description of Artificial Sequence: Synthetic probe
gcaggaaggatggaagtcttcagcttcccgatatccgacggtagtgtgcgatagttctcctgtaaatgga

SEQ ID NO: 2870 - DNA, 70 bp, Artificial Sequence
  Description of Artificial Sequence: Synthetic probe
agtgcctaggacagcatccttcagcttcccgatatccgacggtagtgtagtgcaaaaaagtgcttcactt

SEQ ID NO: 2871 - DNA, 70 bp, Artificial Sequence
  Description of Artificial Sequence: Synthetic probe
cgaggacaaaaagacacgcttcagcttcccgatatccgacggtagtgtggcttcttatccggtaagacac

SEQ ID NO: 2872 - DNA, 70 bp, Artificial Sequence
  Description of Artificial Sequence: Synthetic probe
tttttgttttttaaaaaagcaccttcagcttcccgatatccgacggtagtgtccaaggtcgacatctttg

SEQ ID NO: 2873 - DNA, 70 bp, Artificial Sequence
  Description of Artificial Sequence: Synthetic probe
caaaggcctctaccagacttcagcttcccgatatccgacggtagtgtaggaattgttatcaaaacatatt

SEQ ID NO: 2874 - DNA, 70 bp, Artificial Sequence
  Description of Artificial Sequence: Synthetic probe
acttgcttcttggtctggcttcagcttcccgatatccgacggtagtgtggtataatagaaggaacaaaac

SEQ ID NO: 2875 - DNA, 70 bp, Artificial Sequence
  Description of Artificial Sequence: Synthetic probe
tcataatctaaactccttaaaagcgcttcagcttcccgatatccgacggtagtgtagagagcaaagcagg

SEQ ID NO: 2876 - DNA, 70 bp, Artificial Sequence
  Description of Artificial Sequence: Synthetic probe
atagttctcctgtaaatggacttcagcttcccgatatccgacggtagtgtagaagtcatctctagccctt

SEQ ID NO: 2877 - DNA, 70 bp, Artificial Sequence
  Description of Artificial Sequence: Synthetic probe
tgcaaaaaagtgcttcacttccttcagcttcccgatatccgacggtagtgtacaatcactgtgacagtag

SEQ ID NO: 2878 - DNA, 70 bp, Artificial Sequence
  Description of Artificial Sequence: Synthetic probe
cttcttatccggtaagacaccttcagcttcccgatatccgacggtagtgtccaggtggcattgttccata

SEQ ID NO: 2879 - DNA, 70 bp, Artificial Sequence
  Description of Artificial Sequence: Synthetic probe
ctccaaggtcgacatctttcttcagcttcccgatatccgacggtagtgttcaaaggcctctaccagaaaa

SEQ ID NO: 2880 - DNA, 70 bp, Artificial Sequence
  Description of Artificial Sequence: Synthetic probe
taataagcagaagaatagttcttcagcttcccgatatccgacggtagtgtacttgcttcttggtctggaa

SEQ ID NO: 2881 - DNA, 70 bp, Artificial Sequence
  Description of Artificial Sequence: Synthetic probe
attccgactttcttcatcacttcagcttcccgatatccgacggtagtgtggcataatttaaacccatact

SEQ ID NO: 2882 - DNA, 70 bp, Artificial Sequence
  Description of Artificial Sequence: Synthetic probe
actatggtagctggtggtcttcagcttcccgatatccgacggtagtgtggggaattatccatggatttgg

SEQ ID NO: 2883 - DNA, 70 bp, Artificial Sequence
  Description of Artificial Sequence: Synthetic probe
tagctagtttgcaatctcttcagcttcccgatatccgacggtagtgttgaaactttcattttagtacctc

SEQ ID NO: 2884 - DNA, 70 bp, Artificial Sequence
  Description of Artificial Sequence: Synthetic probe
aaaataaccaaaagtaataattcttcagcttcccgatatccgacggtagtgtagtagattgagaattaaa

SEQ ID NO: 2885 - DNA, 70 bp, Artificial Sequence
  Description of Artificial Sequence: Synthetic probe
tgcaggggcacacacacttcagcttcccgatatccgacggtagtgttctgaagaaaaccctcttagataa

SEQ ID NO: 2886 - DNA, 70 bp, Artificial Sequence
  Description of Artificial Sequence: Synthetic probe
aaattcattgagatgtcttcagcttcccgatatccgacggtagtgtacatttgtaaaataaaaaactcac

SEQ ID NO: 2887 - DNA, 70 bp, Artificial Sequence
  Description of Artificial Sequence: Synthetic probe
tttaaaaaggaaaatcttgcacttcagcttcccgatatccgacggtagtgtttccgactttcttcatcaa

SEQ ID NO: 2888 - DNA, 70 bp, Artificial Sequence
  Description of Artificial Sequence: Synthetic probe
aattaatatgcatcactacaattcttcagcttcccgatatccgacggtagtgtatggtagctggtggtcc

SEQ ID NO: 2889 - DNA, 70 bp, Artificial Sequence
  Description of Artificial Sequence: Synthetic probe
ctgcatcttcagcatcttcagcttcccgatatccgacggtagtgttgaaataagtaaaagaacataaaat

SEQ ID NO: 2890 - DNA, 70 bp, Artificial Sequence
  Description of Artificial Sequence: Synthetic probe
gataggtgtacccttgaccttcagcttcccgatatccgacggtagtgttgaataaatagggtgaaattta

SEQ ID NO: 2891 - DNA, 70 bp, Artificial Sequence
  Description of Artificial Sequence: Synthetic probe
ggagccaccatcccttcttcagcttcccgatatccgacggtagtgtagagactacttttgctgtcttgtg

SEQ ID NO: 2892 - DNA, 70 bp, Artificial Sequence
  Description of Artificial Sequence: Synthetic probe
gtttactaaagacaggaggcttcagcttcccgatatccgacggtagtgtggtcatttatgagtgttaagg

SEQ ID NO: 2893 - DNA, 70 bp, Artificial Sequence
  Description of Artificial Sequence: Synthetic probe
attcatatcctgtaaaacaccttcagcttcccgatatccgacggtagtgttctcagtacagttcagaata

SEQ ID NO: 2894 - DNA, 70 bp, Artificial Sequence
  Description of Artificial Sequence: Synthetic probe
ggagtttagtacttcagttgcttcagcttcccgatatccgacggtagtgtcaatgccttctacttacagg

SEQ ID NO: 2895 - DNA, 70 bp, Artificial Sequence
  Description of Artificial Sequence: Synthetic probe
aggttagggatacagttactcttcagcttcccgatatccgacggtagtgtctgcatcttcagcataaact

SEQ ID NO: 2896 - DNA, 70 bp, Artificial Sequence
  Description of Artificial Sequence: Synthetic probe
gactcccagtcttcatatcacaccttcagcttcccgatatccgacggtagtgtaggtgtacccttgactg

SEQ ID NO: 2897 - DNA, 70 bp, Artificial Sequence
  Description of Artificial Sequence: Synthetic probe
cttatttaccactgtcagcccttcagcttcccgatatccgacggtagtgtggagccaccatccctttgta

SEQ ID NO: 2898 - DNA, 70 bp, Artificial Sequence
  Description of Artificial Sequence: Synthetic probe
tcctctcaattccattactccttcagcttcccgatatccgacggtagtgtgtttactaaagacaggagga

SEQ ID NO: 2899 - DNA, 70 bp, Artificial Sequence
  Description of Artificial Sequence: Synthetic probe
ttaaaaattgttgtaggttcttcagcttcccgatatccgacggtagtgttgtaagtttctaagagaaaaa

SEQ ID NO: 2900 - DNA, 70 bp, Artificial Sequence
  Description of Artificial Sequence: Synthetic probe
taagattgactcgtgtcttcagcttcccgatatccgacggtagtgtaaattgtaatttaaaaaaattaaa

SEQ ID NO: 2901 - DNA, 70 bp, Artificial Sequence
  Description of Artificial Sequence: Synthetic probe
atttccatattttcattctcttcagcttcccgatatccgacggtagtgtacatcatctactctatacctc

SEQ ID NO: 2902 - DNA, 70 bp, Artificial Sequence
  Description of Artificial Sequence: Synthetic probe
tccagaatcttcttccacttcagcttcccgatatccgacggtagtgtggagaaaaattgaaagaaaaaaa

SEQ ID NO: 2903 - DNA, 70 bp, Artificial Sequence
  Description of Artificial Sequence: Synthetic probe
atactggcagggtaaggacttcagcttcccgatatccgacggtagtgtgctgtcatctgttaagccaaat

SEQ ID NO: 2904 - DNA, 70 bp, Artificial Sequence
  Description of Artificial Sequence: Synthetic probe
catcatctactctatacctcacttcagcttcccgatatccgacggtagtgttcaaaaattaaacatcaaa

SEQ ID NO: 2905 - DNA, 70 bp, Artificial Sequence
  Description of Artificial Sequence: Synthetic probe
acttgcaggtaatccctcttcagcttcccgatatccgacggtagtgtgaccacataatgaaaagagacac

SEQ ID NO: 2906 - DNA, 70 bp, Artificial Sequence
  Description of Artificial Sequence: Synthetic probe
attattaattattaatttgctgtcttcagcttcccgatatccgacggtagtgtaaaattgttgtaggttc

SEQ ID NO: 2907 - DNA, 70 bp, Artificial Sequence
  Description of Artificial Sequence: Synthetic probe
ccaagttaaaacacagtgcaacttcagcttcccgatatccgacggtagtgtaagattgactcgtgttatt

SEQ ID NO: 2908 - DNA, 70 bp, Artificial Sequence
  Description of Artificial Sequence: Synthetic probe
aatattaaatggatctttaaacttcagcttcccgatatccgacggtagtgtccagaatcttcttccactt

SEQ ID NO: 2909 - DNA, 70 bp, Artificial Sequence
  Description of Artificial Sequence: Synthetic probe
atggtcttttagaagtgaaaatcttcagcttcccgatatccgacggtagtgtactggcagggtaaggaaa

SEQ ID NO: 2910 - DNA, 70 bp, Artificial Sequence
  Description of Artificial Sequence: Synthetic probe
ttcctcctgtgtgaagccttcagcttcccgatatccgacggtagtgtatttaaactatattttatgttaa

SEQ ID NO: 2911 - DNA, 70 bp, Artificial Sequence
  Description of Artificial Sequence: Synthetic probe
tcaccaggatgtaagacacttcagcttcccgatatccgacggtagtgtagaaacgcctaaaccaaaattg

SEQ ID NO: 2912 - DNA, 70 bp, Artificial Sequence
  Description of Artificial Sequence: Synthetic probe
tcactgtggcactgccttcagcttcccgatatccgacggtagtgtgaagtctactcataaattcatatta

SEQ ID NO: 2913 - DNA, 70 bp, Artificial Sequence
  Description of Artificial Sequence: Synthetic probe
aggctccccatcatcaacttcagcttcccgatatccgacggtagtgttcaattttgagagactcctttca

SEQ ID NO: 2914 - DNA, 70 bp, Artificial Sequence
  Description of Artificial Sequence: Synthetic probe
accaccaacttaaaaagcacttcagcttcccgatatccgacggtagtgttgccctaaacatttcgtgtat

SEQ ID NO: 2915 - DNA, 70 bp, Artificial Sequence
  Description of Artificial Sequence: Synthetic probe
attcatgttaaagattataagtcttcagcttcccgatatccgacggtagtgttcggacagaaatcaatac

SEQ ID NO: 2916 - DNA, 70 bp, Artificial Sequence
  Description of Artificial Sequence: Synthetic probe
aacagcgtaacagcacaatttcttcagcttcccgatatccgacggtagtgttcctcctgtgtgaagcgtg

SEQ ID NO: 2917 - DNA, 70 bp, Artificial Sequence
  Description of Artificial Sequence: Synthetic probe
atgtatgtttttacttattggcttcagcttcccgatatccgacggtagtgtcaccaggatgtaagacaag

SEQ ID NO: 2918 - DNA, 70 bp, Artificial Sequence
  Description of Artificial Sequence: Synthetic probe
cctggttccagaaggggaagcttcagcttcccgatatccgacggtagtgttcactgtggcactgctggac

SEQ ID NO: 2919 - DNA, 70 bp, Artificial Sequence
  Description of Artificial Sequence: Synthetic probe
atcatttcctcactgcctcttcagcttcccgatatccgacggtagtgtacaggctccccatcatcaaaag

SEQ ID NO: 2920 - DNA, 70 bp, Artificial Sequence
  Description of Artificial Sequence: Synthetic probe
tcatttcctgaaacaatggcttcagcttcccgatatccgacggtagtgtggatacatggttaacaattac

SEQ ID NO: 2921 - DNA, 70 bp, Artificial Sequence
  Description of Artificial Sequence: Synthetic probe
caatactttgattaatggcacttcagcttcccgatatccgacggtagtgtagatgggcacaattttatta

SEQ ID NO: 2922 - DNA, 70 bp, Artificial Sequence
  Description of Artificial Sequence: Synthetic probe
agaaattacaccaaccatggtccctcttcagcttcccgatatccgacggtagtgtgaatagataataatt

SEQ ID NO: 2923 - DNA, 70 bp, Artificial Sequence
  Description of Artificial Sequence: Synthetic probe
ttggtggcaagttcactcttcagcttcccgatatccgacggtagtgtaattcaatctgaaattaggccaa

SEQ ID NO: 2924 - DNA, 70 bp, Artificial Sequence
  Description of Artificial Sequence: Synthetic probe
gaggtctgcaggtttagagacttcagcttcccgatatccgacggtagtgtagtttactggttgatggtga

SEQ ID NO: 2925 - DNA, 70 bp, Artificial Sequence
  Description of Artificial Sequence: Synthetic probe
atgtatttatttttaaatatcttcagcttcccgatatccgacggtagtgtcaaactaaaagtctactcac

SEQ ID NO: 2926 - DNA, 70 bp, Artificial Sequence
  Description of Artificial Sequence: Synthetic probe
ttgatgtaactttacgttcacttcagcttcccgatatccgacggtagtgttcatttcctgaaacaatgga

SEQ ID NO: 2927 - DNA, 70 bp, Artificial Sequence
  Description of Artificial Sequence: Synthetic probe
aaattgagagaaagataagacttcagcttcccgatatccgacggtagtgtcaatactttgattaatggca

SEQ ID NO: 2928 - DNA, 70 bp, Artificial Sequence
  Description of Artificial Sequence: Synthetic probe
ctgatataccctctgccccttcagcttcccgatatccgacggtagtgtgcagaaattacaccaaccatgg

SEQ ID NO: 2929 - DNA, 70 bp, Artificial Sequence
  Description of Artificial Sequence: Synthetic probe
ttcatggcctcctccacttcagcttcccgatatccgacggtagtgtccctttggtggcaagttcacttac

SEQ ID NO: 2930 - DNA, 70 bp, Artificial Sequence
  Description of Artificial Sequence: Synthetic probe
ttttgaaggaactcggagacttcagcttcccgatatccgacggtagtgtctgtttaaacgaataggcaat

SEQ ID NO: 2931 - DNA, 70 bp, Artificial Sequence
  Description of Artificial Sequence: Synthetic probe
aggaccacttccagggacttcagcttcccgatatccgacggtagtgttctcagagtattaatgatctttc

SEQ ID NO: 2932 - DNA, 70 bp, Artificial Sequence
  Description of Artificial Sequence: Synthetic probe
agagtgatgcatgaaagtgcttcagcttcccgatatccgacggtagtgtcacatagataacacctgtgat

SEQ ID NO: 2933 - DNA, 70 bp, Artificial Sequence
  Description of Artificial Sequence: Synthetic probe
ggactcgaagtacatagccttcagcttcccgatatccgacggtagtgtgttgtccactgagaatgatatt

SEQ ID NO: 2934 - DNA, 70 bp, Artificial Sequence
  Description of Artificial Sequence: Synthetic probe
ggtctcataatccagaggcttcagcttcccgatatccgacggtagtgtgacataggtatttcatttaaaa

SEQ ID NO: 2935 - DNA, 70 bp, Artificial Sequence
  Description of Artificial Sequence: Synthetic probe
acatagataacacctgtgacttcagcttcccgatatccgacggtagtgtagcagagacaccatacaattc

SEQ ID NO: 2936 - DNA, 70 bp, Artificial Sequence
  Description of Artificial Sequence: Synthetic probe
taattccaaatgtatctagacttcagcttcccgatatccgacggtagtgtaaagctttaagtagtataac

SEQ ID NO: 2937 - DNA, 70 bp, Artificial Sequence
  Description of Artificial Sequence: Synthetic probe
aaatacaattacctggtcattgtcttcagcttcccgatatccgacggtagtgttgaaggaactcggagat

SEQ ID NO: 2938 - DNA, 70 bp, Artificial Sequence
  Description of Artificial Sequence: Synthetic probe
ttacgctataaggaaagaaacttcagcttcccgatatccgacggtagtgtaggaccacttccagggaatc

SEQ ID NO: 2939 - DNA, 70 bp, Artificial Sequence
  Description of Artificial Sequence: Synthetic probe
tttaaaaggcactgtgattcttcagcttcccgatatccgacggtagtgttggactcgaagtacatagctt

SEQ ID NO: 2940 - DNA, 70 bp, Artificial Sequence
  Description of Artificial Sequence: Synthetic probe
acactaaaaatgcctatttcttcagcttcccgatatccgacggtagtgttggtctcataatccagaggtc

SEQ ID NO: 2941 - DNA, 70 bp, Artificial Sequence
  Description of Artificial Sequence: Synthetic probe
tgagtacagaagtaaacacttcagcttcccgatatccgacggtagtgtgataactaaactaatatagctc

SEQ ID NO: 2942 - DNA, 70 bp, Artificial Sequence
  Description of Artificial Sequence: Synthetic probe
atcttcagatacacctccgcttcagcttcccgatatccgacggtagtgttttcaggcttttgtttataca

SEQ ID NO: 2943 - DNA, 70 bp, Artificial Sequence
  Description of Artificial Sequence: Synthetic probe
aattttttctgaaacactgggcttcagcttcccgatatccgacggtagtgtgtatgcagttaatgcaaac

SEQ ID NO: 2944 - DNA, 70 bp, Artificial Sequence
  Description of Artificial Sequence: Synthetic probe
gattattttcatcctgaatccttcagcttcccgatatccgacggtagtgtgcttacagcttatctgcaaa

SEQ ID NO: 2945 - DNA, 70 bp, Artificial Sequence
  Description of Artificial Sequence: Synthetic probe
gtatactttagctgtattgcccttcagcttcccgatatccgacggtagtgtgcttttactttagttctgt

SEQ ID NO: 2946 - DNA, 70 bp, Artificial Sequence
  Description of Artificial Sequence: Synthetic probe
ggacaagaaacgatgcatttcttcagcttcccgatatccgacggtagtgtaacataattccgcatacctt

SEQ ID NO: 2947 - DNA, 70 bp, Artificial Sequence
  Description of Artificial Sequence: Synthetic probe
tggtggttattcatggggcttcagcttcccgatatccgacggtagtgttctgagtacagaagtaaacatt

SEQ ID NO: 2948 - DNA, 70 bp, Artificial Sequence
  Description of Artificial Sequence: Synthetic probe
tgcactgaagtaaatacttcagcttcccgatatccgacggtagtgtttgcatcttcagatacacctccga

SEQ ID NO: 2949 - DNA, 70 bp, Artificial Sequence
  Description of Artificial Sequence: Synthetic probe
cttttttttggaaacattgacttcagcttcccgatatccgacggtagtgtaattttttctgaaacactgg

SEQ ID NO: 2950 - DNA, 70 bp, Artificial Sequence
  Description of Artificial Sequence: Synthetic probe
aatcaaaagccatttctagcttcagcttcccgatatccgacggtagtgttgattattttcatcctgaatc

SEQ ID NO: 2951 - DNA, 70 bp, Artificial Sequence
  Description of Artificial Sequence: Synthetic probe
tcagtcccttcccatcttcagcttcccgatatccgacggtagtgtacaatctgagtgaaaataataatta

SEQ ID NO: 2952 - DNA, 70 bp, Artificial Sequence
  Description of Artificial Sequence: Synthetic probe
tgcaataacttgaaacttgacttcagcttcccgatatccgacggtagtgtttgaaaacccgttttaaatt

SEQ ID NO: 2953 - DNA, 70 bp, Artificial Sequence
  Description of Artificial Sequence: Synthetic probe
tatgaaatggcttacttttgcttcagcttcccgatatccgacggtagtgttgtttccactacaaatcctt

SEQ ID NO: 2954 - DNA, 70 bp, Artificial Sequence
  Description of Artificial Sequence: Synthetic probe
aagaatgaggtttcttatgtcttcagcttcccgatatccgacggtagtgtccctctttaattggtggtat

SEQ ID NO: 2955 - DNA, 70 bp, Artificial Sequence
  Description of Artificial Sequence: Synthetic probe
taacacaataaagccctcctcttcagcttcccgatatccgacggtagtgtgtctgtaggccatgacacta

SEQ ID NO: 2956 - DNA, 70 bp, Artificial Sequence
  Description of Artificial Sequence: Synthetic probe
gatctcctcatattatggaagcttcagcttcccgatatccgacggtagtgtagaagttctataaactgaa

SEQ ID NO: 2957 - DNA, 70 bp, Artificial Sequence
  Description of Artificial Sequence: Synthetic probe
tagcagttttgataagccctcttcagcttcccgatatccgacggtagtgttgacctatggctagtatcgt

SEQ ID NO: 2958 - DNA, 70 bp, Artificial Sequence
  Description of Artificial Sequence: Synthetic probe
tgtttccactacaaatcctcttcagcttcccgatatccgacggtagtgtacttccctttcctgaagtttt

SEQ ID NO: 2959 - DNA, 70 bp, Artificial Sequence
  Description of Artificial Sequence: Synthetic probe
ccctctttaattggtggtacttcagcttcccgatatccgacggtagtgtacttacgagtacatcggcttt

SEQ ID NO: 2960 - DNA, 70 bp, Artificial Sequence
  Description of Artificial Sequence: Synthetic probe
gtctgtaggccatgacaccttcagcttcccgatatccgacggtagtgtgctcagtcccttcccatagtcg

SEQ ID NO: 2961 - DNA, 70 bp, Artificial Sequence
  Description of Artificial Sequence: Synthetic probe
gccagtatctttatcagtagccttcagcttcccgatatccgacggtagtgtgcaataacttgaaacttga

SEQ ID NO: 2962 - DNA, 70 bp, Artificial Sequence
  Description of Artificial Sequence: Synthetic probe
acggaggggaaaaaaaaacttcagcttcccgatatccgacggtagtgtaggatctcctcatattatggaa

SEQ ID NO: 2963 - DNA, 70 bp, Artificial Sequence
  Description of Artificial Sequence: Synthetic probe
taattaagcaggaaaagataaccttcagcttcccgatatccgacggtagtgtgcagttttgataagccct

SEQ ID NO: 2964 - DNA, 70 bp, Artificial Sequence
  Description of Artificial Sequence: Synthetic probe
gatcttctatctttttttccaccttcagcttcccgatatccgacggtagtgtagcctaaacctcaccaat

SEQ ID NO: 2965 - DNA, 70 bp, Artificial Sequence
  Description of Artificial Sequence: Synthetic probe
agtaggaggcacattggcttcagcttcccgatatccgacggtagtgtgcaatatatccatgtaacacacc

SEQ ID NO: 2966 - DNA, 70 bp, Artificial Sequence
  Description of Artificial Sequence: Synthetic probe
acttgcatatccagctgacttcagcttcccgatatccgacggtagtgtacatgtatcccctgaatctaaa

SEQ ID NO: 2967 - DNA, 70 bp, Artificial Sequence
  Description of Artificial Sequence: Synthetic probe
cggagacctgaaagaagcttcagcttcccgatatccgacggtagtgtaaaatttaaaaaatacagttaaa

SEQ ID NO: 2968 - DNA, 70 bp, Artificial Sequence
  Description of Artificial Sequence: Synthetic probe
gaattcatttaatttttactcttcagcttcccgatatccgacggtagtgttggtcatataaaaataaata

SEQ ID NO: 2969 - DNA, 70 bp, Artificial Sequence
  Description of Artificial Sequence: Synthetic probe
aaatttccataatcagaaaaccccccttcagcttcccgatatccgacggtagtgtcaaaatcaattactc

SEQ ID NO: 2970 - DNA, 70 bp, Artificial Sequence
  Description of Artificial Sequence: Synthetic probe
acattacctcttccctactcttcagcttcccgatatccgacggtagtgtagatcttctatctttttttcc

SEQ ID NO: 2971 - DNA, 70 bp, Artificial Sequence
  Description of Artificial Sequence: Synthetic probe
agacacagtggtttctgacttcagcttcccgatatccgacggtagtgtagagtaggaggcacattggaaa

SEQ ID NO: 2972 - DNA, 70 bp, Artificial Sequence
  Description of Artificial Sequence: Synthetic probe
attcaggaacaaatatatatacacttcagcttcccgatatccgacggtagtgttgcatatccagctgatt

SEQ ID NO: 2973 - DNA, 70 bp, Artificial Sequence
  Description of Artificial Sequence: Synthetic probe
taaaaagctcatttctatcgcttcagcttcccgatatccgacggtagtgttcctaggtatttcaggttct

SEQ ID NO: 2974 - DNA, 70 bp, Artificial Sequence
  Description of Artificial Sequence: Synthetic probe
tctgttggtttgggggtcttcagcttcccgatatccgacggtagtgtgcttacacttcactttcagtaac

SEQ ID NO: 2975 - DNA, 70 bp, Artificial Sequence
  Description of Artificial Sequence: Synthetic probe
aagacatttagtaaatgaaaaatgcttcagcttcccgatatccgacggtagtgtcggcgagctccaatgg

SEQ ID NO: 2976 - DNA, 70 bp, Artificial Sequence
  Description of Artificial Sequence: Synthetic probe
tgacagcctagttttttgttaatcttcagcttcccgatatccgacggtagtgtacgaccttggcaccagg

SEQ ID NO: 2977 - DNA, 70 bp, Artificial Sequence
  Description of Artificial Sequence: Synthetic probe
ttactgaatataaacccttgaacttcagcttcccgatatccgacggtagtgttcctgaacatagcgatcc

SEQ ID NO: 2978 - DNA, 70 bp, Artificial Sequence
  Description of Artificial Sequence: Synthetic probe
tagacagtcaagtcacattcttcagcttcccgatatccgacggtagtgttggtgggttttaaactttaag

SEQ ID NO: 2979 - DNA, 70 bp, Artificial Sequence
  Description of Artificial Sequence: Synthetic probe
aatcttctagggaaaaggcatccttcagcttcccgatatccgacggtagtgtagcctcaagtcagaatca

SEQ ID NO: 2980 - DNA, 70 bp, Artificial Sequence
  Description of Artificial Sequence: Synthetic probe
atgccggcgagctcccttcagcttcccgatatccgacggtagtgttctatggttgctattgtaaccaaag

SEQ ID NO: 2981 - DNA, 70 bp, Artificial Sequence
  Description of Artificial Sequence: Synthetic probe
actacgaccttggcaccttcagcttcccgatatccgacggtagtgtgctgttacagataacaaaaagcac

SEQ ID NO: 2982 - DNA, 70 bp, Artificial Sequence
  Description of Artificial Sequence: Synthetic probe
gttcctgaacatagcgacttcagcttcccgatatccgacggtagtgtacttaaaaagctcatttctatcg

SEQ ID NO: 2983 - DNA, 70 bp, Artificial Sequence
  Description of Artificial Sequence: Synthetic probe
cctataaatcaaacaaagtacacttcagcttcccgatatccgacggtagtgttgttggtttgggggtcaa

SEQ ID NO: 2984 - DNA, 70 bp, Artificial Sequence
  Description of Artificial Sequence: Synthetic probe
atgacagtccaatgggccttcagcttcccgatatccgacggtagtgtgcatagacagtcaagtcacattt

SEQ ID NO: 2985 - DNA, 70 bp, Artificial Sequence
  Description of Artificial Sequence: Synthetic probe
agtaaaaaattactcttaacttcttcagcttcccgatatccgacggtagtgttcttctagggaaaaggca

SEQ ID NO: 2986 - DNA, 70 bp, Artificial Sequence
  Description of Artificial Sequence: Synthetic probe
gtctgtagctgaccaaaacccttcagcttcccgatatccgacggtagtgtatcatttggtacgagataga

SEQ ID NO: 2987 - DNA, 70 bp, Artificial Sequence
  Description of Artificial Sequence: Synthetic probe
gatggcaggaatgcagccttcagcttcccgatatccgacggtagtgtgacagataaagcaatctcagagt

SEQ ID NO: 2988 - DNA, 70 bp, Artificial Sequence
  Description of Artificial Sequence: Synthetic probe
tgctagcagagaaagagccttcagcttcccgatatccgacggtagtgttctcctctctttttaatgctgg

SEQ ID NO: 2989 - DNA, 70 bp, Artificial Sequence
  Description of Artificial Sequence: Synthetic probe
aaataaaatctttttgtaagatccttcagcttcccgatatccgacggtagtgttctggagtccggatctc

SEQ ID NO: 2990 - DNA, 70 bp, Artificial Sequence
  Description of Artificial Sequence: Synthetic probe
tcaatattttctctaattgaacttcagcttcccgatatccgacggtagtgtgcgtcctccttccccataa

SEQ ID NO: 2991 - DNA, 70 bp, Artificial Sequence
  Description of Artificial Sequence: Synthetic probe
aagctgagtcagaagtctcatgacttcagcttcccgatatccgacggtagtgtaaagtctttattgatat

SEQ ID NO: 2992 - DNA, 70 bp, Artificial Sequence
  Description of Artificial Sequence: Synthetic probe
atgatgaaggccagagcccttcagcttcccgatatccgacggtagtgttgcaccatcaatattttacaac

SEQ ID NO: 2993 - DNA, 70 bp, Artificial Sequence
  Description of Artificial Sequence: Synthetic probe
ccccttctgtgtatcctagacttcagcttcccgatatccgacggtagtgtgccatgttaccagagatggt

SEQ ID NO: 2994 - DNA, 70 bp, Artificial Sequence
  Description of Artificial Sequence: Synthetic probe
tcctctctttttaatgctggcttcagcttcccgatatccgacggtagtgtgcaatgacttctgaggaact

SEQ ID NO: 2995 - DNA, 70 bp, Artificial Sequence
  Description of Artificial Sequence: Synthetic probe
gcctctggagtccggacttcagcttcccgatatccgacggtagtgttccaggtttaccatccttgaatac

SEQ ID NO: 2996 - DNA, 70 bp, Artificial Sequence
  Description of Artificial Sequence: Synthetic probe
tgcgtcctccttccccacttcagcttcccgatatccgacggtagtgtactgtctgtagctgaccaaaacc

SEQ ID NO: 2997 - DNA, 70 bp, Artificial Sequence
  Description of Artificial Sequence: Synthetic probe
ctgaaagtctttattgatatcacttcagcttcccgatatccgacggtagtgttggcaggaatgcagcaga

SEQ ID NO: 2998 - DNA, 70 bp, Artificial Sequence
  Description of Artificial Sequence: Synthetic probe
agtttgccatccaaaaatcttcttcagcttcccgatatccgacggtagtgttgatgaaggccagagccaa

SEQ ID NO: 2999 - DNA, 70 bp, Artificial Sequence
  Description of Artificial Sequence: Synthetic probe
gttagataaatagtaaaattcttcagcttcccgatatccgacggtagtgtccccttctgtgtatcctaga

SEQ ID NO: 3000 - DNA, 70 bp, Artificial Sequence
  Description of Artificial Sequence: Synthetic probe
tctctatccagaactcttccttcagcttcccgatatccgacggtagtgtcttctttaaatgagttaaaga

SEQ ID NO: 3001 - DNA, 70 bp, Artificial Sequence
  Description of Artificial Sequence: Synthetic probe
tgttcaggaaaagcatttgccttcagcttcccgatatccgacggtagtgtttgttgctatactcaggaaa

SEQ ID NO: 3002 - DNA, 70 bp, Artificial Sequence
  Description of Artificial Sequence: Synthetic probe
atcagttttaaagctgaaaataccttcagcttcccgatatccgacggtagtgttggggtctggtcctcca

SEQ ID NO: 3003 - DNA, 70 bp, Artificial Sequence
  Description of Artificial Sequence: Synthetic probe
aactgtatatctagcataagcttcagcttcccgatatccgacggtagtgtccctttgatcagcatgttgt

SEQ ID NO: 3004 - DNA, 70 bp, Artificial Sequence
  Description of Artificial Sequence: Synthetic probe
aggatccatcaacaccccttcagcttcccgatatccgacggtagtgtaactcaaattatgtaaataattc

SEQ ID NO: 3005 - DNA, 70 bp, Artificial Sequence
  Description of Artificial Sequence: Synthetic probe
acattatcctttaaagaaagcttcagcttcccgatatccgacggtagtgtcatataaacacacacataga

SEQ ID NO: 3006 - DNA, 70 bp, Artificial Sequence
  Description of Artificial Sequence: Synthetic probe
tggtggggtctggtccttcagcttcccgatatccgacggtagtgtcatttaaattataataaacttatat

SEQ ID NO: 3007 - DNA, 70 bp, Artificial Sequence
  Description of Artificial Sequence: Synthetic probe
ccctttgatcagcatgtcttcagcttcccgatatccgacggtagtgtcaggggcaaagaaaaaaaatcac

SEQ ID NO: 3008 - DNA, 70 bp, Artificial Sequence
  Description of Artificial Sequence: Synthetic probe
agaattgtacctgcaaaccacttcagcttcccgatatccgacggtagtgttctctatccagaactcttcc

SEQ ID NO: 3009 - DNA, 70 bp, Artificial Sequence
  Description of Artificial Sequence: Synthetic probe
aggtacttgaaaacatattctcttcagcttcccgatatccgacggtagtgtgttcaggaaaagcatttgc

SEQ ID NO: 3010 - DNA, 70 bp, Artificial Sequence
  Description of Artificial Sequence: Synthetic probe
atatgaattctttagcaaagacttcagcttcccgatatccgacggtagtgtggatccatcaacacccagt

SEQ ID NO: 3011 - DNA, 70 bp, Artificial Sequence
  Description of Artificial Sequence: Synthetic probe
gctcttaaaccgcggctcttcagcttcccgatatccgacggtagtgttccacattatcctttaaagaaag

SEQ ID NO: 3012 - DNA, 70 bp, Artificial Sequence
  Description of Artificial Sequence: Synthetic probe
tttaaacctgtttgggaacttcagcttcccgatatccgacggtagtgtctatatatatcaaaccaagaaa

SEQ ID NO: 3013 - DNA, 70 bp, Artificial Sequence
  Description of Artificial Sequence: Synthetic probe
gtaagaaaaatagaaagctacattacttcagcttcccgatatccgacggtagtgtcaaacgcaaaacaag

SEQ ID NO: 3014 - DNA, 70 bp, Artificial Sequence
  Description of Artificial Sequence: Synthetic probe
gaactattgcattaataacatcttcagcttcccgatatccgacggtagtgtagatgtggttctgagcagg

SEQ ID NO: 3015 - DNA, 70 bp, Artificial Sequence
  Description of Artificial Sequence: Synthetic probe
acatctgatttattctaaatccttcagcttcccgatatccgacggtagtgttgattgatataatctcggg

SEQ ID NO: 3016 - DNA, 70 bp, Artificial Sequence
  Description of Artificial Sequence: Synthetic probe
ataatttatacgttaaattcacttcagcttcccgatatccgacggtagtgtttttcctattacatgaaaa

SEQ ID NO: 3017 - DNA, 70 bp, Artificial Sequence
  Description of Artificial Sequence: Synthetic probe
gacagagttaatgacagacttcagcttcccgatatccgacggtagtgttgtgtaaaatgttaattatact

SEQ ID NO: 3018 - DNA, 70 bp, Artificial Sequence
  Description of Artificial Sequence: Synthetic probe
ttgagctgtctccaagttccttcagcttcccgatatccgacggtagtgtttttcgtcttaacaaattttc

SEQ ID NO: 3019 - DNA, 70 bp, Artificial Sequence
  Description of Artificial Sequence: Synthetic probe
gagatgcgcacctggcttcagcttcccgatatccgacggtagtgttcttgaaaataatagaataaaataa

SEQ ID NO: 3020 - DNA, 70 bp, Artificial Sequence
  Description of Artificial Sequence: Synthetic probe
gaacccactaaaattattttacaccttcagcttcccgatatccgacggtagtgtgcgggtaatgcggcct

SEQ ID NO: 3021 - DNA, 70 bp, Artificial Sequence
  Description of Artificial Sequence: Synthetic probe
aacatcaatttataaacagacttcagcttcccgatatccgacggtagtgtcgtgcagtctttgtacactc

SEQ ID NO: 3022 - DNA, 70 bp, Artificial Sequence
  Description of Artificial Sequence: Synthetic probe
ggcggcggcgggggccttcagcttcccgatatccgacggtagtgtatagtccatgtaggcatttccacat

SEQ ID NO: 3023 - DNA, 70 bp, Artificial Sequence
  Description of Artificial Sequence: Synthetic probe
gtgcaggagccggcacttcagcttcccgatatccgacggtagtgtcagattgaaattaaatactcaccac

SEQ ID NO: 3024 - DNA, 70 bp, Artificial Sequence
  Description of Artificial Sequence: Synthetic probe
agccgcgggtaatgccttcagcttcccgatatccgacggtagtgtacagaattcagtaaaacccaactac

SEQ ID NO: 3025 - DNA, 70 bp, Artificial Sequence
  Description of Artificial Sequence: Synthetic probe
cgtgcagtctttgtacactcttcagcttcccgatatccgacggtagtgtcagagttcctgaacggtctac

SEQ ID NO: 3026 - DNA, 70 bp, Artificial Sequence
  Description of Artificial Sequence: Synthetic probe
gacgtcttggataaagtaaggcttcagcttcccgatatccgacggtagtgttgagctgtctccaagttct

SEQ ID NO: 3027 - DNA, 70 bp, Artificial Sequence
  Description of Artificial Sequence: Synthetic probe
cttgtaaaactcattttagaaatcacttcagcttcccgatatccgacggtagtgtgcgcacctggcggag

SEQ ID NO: 3028 - DNA, 70 bp, Artificial Sequence
  Description of Artificial Sequence: Synthetic probe
taatgcttatcaataagccacctttcttcagcttcccgatatccgacggtagtgtcggcgggggcgctgc

SEQ ID NO: 3029 - DNA, 70 bp, Artificial Sequence
  Description of Artificial Sequence: Synthetic probe
taataatggggtccagttatcaggcttcagcttcccgatatccgacggtagtgtaggagccggcactgct

SEQ ID NO: 3030 - DNA, 70 bp, Artificial Sequence
  Description of Artificial Sequence: Synthetic probe
tagattgactgtgagattgtcttcagcttcccgatatccgacggtagtgtattaaaaacgagaaaaaaaa

SEQ ID NO: 3031 - DNA, 70 bp, Artificial Sequence
  Description of Artificial Sequence: Synthetic probe
agttccctcgacaatcttcagcttcccgatatccgacggtagtgtctgcatttcattgaatttggggtaa

SEQ ID NO: 3032 - DNA, 70 bp, Artificial Sequence
  Description of Artificial Sequence: Synthetic probe
tgtcgttgttgatagctgcttcagcttcccgatatccgacggtagtgtgggcacatagtttgaagttctg

SEQ ID NO: 3033 - DNA, 70 bp, Artificial Sequence
  Description of Artificial Sequence: Synthetic probe
gaggacttaattttctcggccttcagcttcccgatatccgacggtagtgttttgtgcgtagatagttttt

SEQ ID NO: 3034 - DNA, 70 bp, Artificial Sequence
  Description of Artificial Sequence: Synthetic probe
tcaagttggtcgtgcacttcagcttcccgatatccgacggtagtgttctatttgactgtacatgttagct

SEQ ID NO: 3035 - DNA, 70 bp, Artificial Sequence
  Description of Artificial Sequence: Synthetic probe
tgttatacagacacactctgtcttcagcttcccgatatccgacggtagtgtttttcaagttctgctaagt

SEQ ID NO: 3036 - DNA, 70 bp, Artificial Sequence
  Description of Artificial Sequence: Synthetic probe
agaaatgaagctgaaggaggcttcagcttcccgatatccgacggtagtgtacgtgtctgaggatgccttt

SEQ ID NO: 3037 - DNA, 70 bp, Artificial Sequence
  Description of Artificial Sequence: Synthetic probe
ggcaaggaatagaaggaggcttcagcttcccgatatccgacggtagtgttctctctgagggtctgtttta

SEQ ID NO: 3038 - DNA, 70 bp, Artificial Sequence
  Description of Artificial Sequence: Synthetic probe
aggaagaggagttggaaacttcagcttcccgatatccgacggtagtgtactgtcgttgttgatagctgtg

SEQ ID NO: 3039 - DNA, 70 bp, Artificial Sequence
  Description of Artificial Sequence: Synthetic probe
agaagaggtggtgttggggcttcagcttcccgatatccgacggtagtgtagaggacttaattttctcggc

SEQ ID NO: 3040 - DNA, 70 bp, Artificial Sequence
  Description of Artificial Sequence: Synthetic probe
acgttgaaacggaaagtggacttcagcttcccgatatccgacggtagtgttcaagttggtcgtgcattta

SEQ ID NO: 3041 - DNA, 70 bp, Artificial Sequence
  Description of Artificial Sequence: Synthetic probe
tgtaggaggaggaagaggcttcagcttcccgatatccgacggtagtgtcctgttatacagacacactctg

SEQ ID NO: 3042 - DNA, 70 bp, Artificial Sequence
  Description of Artificial Sequence: Synthetic probe
ctccccttgttttgttcagatcttcagcttcccgatatccgacggtagtgtagagtcttctttgacgttc

SEQ ID NO: 3043 - DNA, 70 bp, Artificial Sequence
  Description of Artificial Sequence: Synthetic probe
atagaaggaggagagggaggcttcagcttcccgatatccgacggtagtgtagaaatgaagctgaaggagg

SEQ ID NO: 3044 - DNA, 70 bp, Artificial Sequence
  Description of Artificial Sequence: Synthetic probe
aaaaaagagaaaaaggagacttcagcttcccgatatccgacggtagtgtgggcaaggaatagaaggaggt

SEQ ID NO: 3045 - DNA, 70 bp, Artificial Sequence
  Description of Artificial Sequence: Synthetic probe
aggaggaggagcaagaggcttcagcttcccgatatccgacggtagtgtggaggaagaggagttggaaatg

SEQ ID NO: 3046 - DNA, 70 bp, Artificial Sequence
  Description of Artificial Sequence: Synthetic probe
gcaggaggaggagaaggaggcttcagcttcccgatatccgacggtagtgtagaagaggtggtgttggggg

SEQ ID NO: 3047 - DNA, 70 bp, Artificial Sequence
  Description of Artificial Sequence: Synthetic probe
taggaggaggagggggacttcagcttcccgatatccgacggtagtgtcagacgttgaaacggaaagtgga

SEQ ID NO: 3048 - DNA, 70 bp, Artificial Sequence
  Description of Artificial Sequence: Synthetic probe
ggcagaaggagagatgtttgcttcagcttcccgatatccgacggtagtgttgtaggaggaggaagaggaa

SEQ ID NO: 3049 - DNA, 70 bp, Artificial Sequence
  Description of Artificial Sequence: Synthetic probe
tgggcaaaattttcaaaaatatcttcagcttcccgatatccgacggtagtgtagaaggaggagagggagg

SEQ ID NO: 3050 - DNA, 70 bp, Artificial Sequence
  Description of Artificial Sequence: Synthetic probe
tttcggtttcaataggtcttcagcttcccgatatccgacggtagtgtgacaaaaaagagaaaaaggagaa

SEQ ID NO: 3051 - DNA, 70 bp, Artificial Sequence
  Description of Artificial Sequence: Synthetic probe
aataggtgtctctctcctagacttcagcttcccgatatccgacggtagtgtggaggaggagcaagaggag

SEQ ID NO: 3052 - DNA, 70 bp, Artificial Sequence
  Description of Artificial Sequence: Synthetic probe
gaagaatgtaaaacacaaggcccttcagcttcccgatatccgacggtagtgtaggaggaggagaaggagg

SEQ ID NO: 3053 - DNA, 70 bp, Artificial Sequence
  Description of Artificial Sequence: Synthetic probe
tttccatatttgttacttctcttcagcttcccgatatccgacggtagtgttgatgttcaacttgaagact

SEQ ID NO: 3054 - DNA, 70 bp, Artificial Sequence
  Description of Artificial Sequence: Synthetic probe
aaggagaaagttccaaggaacacttcagcttcccgatatccgacggtagtgtggaggaggagggggaagg

SEQ ID NO: 3055 - DNA, 70 bp, Artificial Sequence
  Description of Artificial Sequence: Synthetic probe
agcaggagaactgatgacacttcagcttcccgatatccgacggtagtgtaggcagaaggagagatgtttg

SEQ ID NO: 3056 - DNA, 70 bp, Artificial Sequence
  Description of Artificial Sequence: Synthetic probe
tctgatttgagttccacagtcttcagcttcccgatatccgacggtagtgttgggcaaaattttcaaaaat

SEQ ID NO: 3057 - DNA, 70 bp, Artificial Sequence
  Description of Artificial Sequence: Synthetic probe
aaacagttggcaaagtggcttcagcttcccgatatccgacggtagtgttctttcggtttcaataggtaac

SEQ ID NO: 3058 - DNA, 70 bp, Artificial Sequence
  Description of Artificial Sequence: Synthetic probe
gaagtgaggcctgggaacttcagcttcccgatatccgacggtagtgtacaaataggtgtctctctcctag

SEQ ID NO: 3059 - DNA, 70 bp, Artificial Sequence
  Description of Artificial Sequence: Synthetic probe
gaagagtctgaagagagagcttcagcttcccgatatccgacggtagtgttgaagaatgtaaaacacaagg

SEQ ID NO: 3060 - DNA, 70 bp, Artificial Sequence
  Description of Artificial Sequence: Synthetic probe
actgttctgttccttctatcacttcagcttcccgatatccgacggtagtgtaggagaaagttccaaggaa

SEQ ID NO: 3061 - DNA, 70 bp, Artificial Sequence
  Description of Artificial Sequence: Synthetic probe
tgtttcaccttgccttcttcagcttcccgatatccgacggtagtgtactcagcaggagaactgatgacat

SEQ ID NO: 3062 - DNA, 70 bp, Artificial Sequence
  Description of Artificial Sequence: Synthetic probe
ttctctgtcaaatttgcctccttcagcttcccgatatccgacggtagtgttctgatttgagttccacagt

SEQ ID NO: 3063 - DNA, 70 bp, Artificial Sequence
  Description of Artificial Sequence: Synthetic probe
ttgtaagcaatggattgctgccttcagcttcccgatatccgacggtagtgtaacagttggcaaagtggag

SEQ ID NO: 3064 - DNA, 70 bp, Artificial Sequence
  Description of Artificial Sequence: Synthetic probe
gcacatagtttgaagttctgaacttcagcttcccgatatccgacggtagtgtacaagaggtttgcccgac

SEQ ID NO: 3065 - DNA, 70 bp, Artificial Sequence
  Description of Artificial Sequence: Synthetic probe
tcttttgtttgtacagattccacttcagcttcccgatatccgacggtagtgtagtgaggcctgggaaagc

SEQ ID NO: 3066 - DNA, 70 bp, Artificial Sequence
  Description of Artificial Sequence: Synthetic probe
ttttcattttcagctttctgcccttcagcttcccgatatccgacggtagtgtagagtctgaagagagaga

SEQ ID NO: 3067 - DNA, 70 bp, Artificial Sequence
  Description of Artificial Sequence: Synthetic probe
tgccttgccactgctgccttcagcttcccgatatccgacggtagtgttcaactgttctgttccttctatc

SEQ ID NO: 3068 - DNA, 70 bp, Artificial Sequence
  Description of Artificial Sequence: Synthetic probe
gatctctggtctatttggaacttcagcttcccgatatccgacggtagtgttgtttcaccttgccttattt

SEQ ID NO: 3069 - DNA, 70 bp, Artificial Sequence
  Description of Artificial Sequence: Synthetic probe
ctcatcagcctcctgggcttcagcttcccgatatccgacggtagtgttctttctctgtcaaatttgcctc

SEQ ID NO: 3070 - DNA, 70 bp, Artificial Sequence
  Description of Artificial Sequence: Synthetic probe
ctgactgactccacagcctcttcagcttcccgatatccgacggtagtgtgttgtaagcaatggattgctg

SEQ ID NO: 3071 - DNA, 70 bp, Artificial Sequence
  Description of Artificial Sequence: Synthetic probe
cttttctcttgggcccccttcagcttcccgatatccgacggtagtgtacctcttttgtttgtacagattc

SEQ ID NO: 3072 - DNA, 70 bp, Artificial Sequence
  Description of Artificial Sequence: Synthetic probe
ttactcttggcttgtattcttcagcttcccgatatccgacggtagtgttgttttcattttcagctttctg

SEQ ID NO: 3073 - DNA, 70 bp, Artificial Sequence
  Description of Artificial Sequence: Synthetic probe
aaaatgggtctacaaaatctgtcttcagcttcccgatatccgacggtagtgtccttgccactgctgcaga

SEQ ID NO: 3074 - DNA, 70 bp, Artificial Sequence
  Description of Artificial Sequence: Synthetic probe
ctgtgaaatgtctgaatttcttcagcttcccgatatccgacggtagtgttgatctctggtctatttggaa

SEQ ID NO: 3075 - DNA, 70 bp, Artificial Sequence
  Description of Artificial Sequence: Synthetic probe
tttgtgcgtagatagttttttcttcagcttcccgatatccgacggtagtgtaagaaaagcaacattacag

SEQ ID NO: 3076 - DNA, 70 bp, Artificial Sequence
  Description of Artificial Sequence: Synthetic probe
acttgacttatgttttccttcttcagcttcccgatatccgacggtagtgtctcatcagcctcctgggtaa

SEQ ID NO: 3077 - DNA, 70 bp, Artificial Sequence
  Description of Artificial Sequence: Synthetic probe
ggggattatgggcacttaagtcttcagcttcccgatatccgacggtagtgttgactgactccacagcctc

SEQ ID NO: 3078 - DNA, 70 bp, Artificial Sequence
  Description of Artificial Sequence: Synthetic probe
ctcatcagatagaaatgtgaatttcttcagcttcccgatatccgacggtagtgttctcttgggcccctca

SEQ ID NO: 3079 - DNA, 70 bp, Artificial Sequence
  Description of Artificial Sequence: Synthetic probe
cttgcagacttcagtttgcttcagcttcccgatatccgacggtagtgtacttactcttggcttgtatttt

SEQ ID NO: 3080 - DNA, 70 bp, Artificial Sequence
  Description of Artificial Sequence: Synthetic probe
taagtgatccgtctacacttcagcttcccgatatccgacggtagtgtgtgaaaatgggtctacaaaatct

SEQ ID NO: 3081 - DNA, 70 bp, Artificial Sequence
  Description of Artificial Sequence: Synthetic probe
cttgtgagcctcaatagtcttcagcttcccgatatccgacggtagtgtctctgtgaaatgtctgaatttg

SEQ ID NO: 3082 - DNA, 70 bp, Artificial Sequence
  Description of Artificial Sequence: Synthetic probe
gaaaagggcatcacaacttgcttcagcttcccgatatccgacggtagtgtacttgacttatgttttcctt

SEQ ID NO: 3083 - DNA, 70 bp, Artificial Sequence
  Description of Artificial Sequence: Synthetic probe
gtttcctgtcttctgagactgacttcagcttcccgatatccgacggtagtgtggattatgggcacttaag

SEQ ID NO: 3084 - DNA, 70 bp, Artificial Sequence
  Description of Artificial Sequence: Synthetic probe
atttcccctgctttgttgcttcagcttcccgatatccgacggtagtgttcctcatcagatagaaatgtga

SEQ ID NO: 3085 - DNA, 70 bp, Artificial Sequence
  Description of Artificial Sequence: Synthetic probe
tagagaaggaaaagacttgacttcagcttcccgatatccgacggtagtgtcttgcagacttcagtttgtt

SEQ ID NO: 3086 - DNA, 70 bp, Artificial Sequence
  Description of Artificial Sequence: Synthetic probe
tttgactgtacatgttagccttcagcttcccgatatccgacggtagtgtgtagattgactgtgagattgt

SEQ ID NO: 3087 - DNA, 70 bp, Artificial Sequence
  Description of Artificial Sequence: Synthetic probe
aagaagataatgaaatgtaaggcttcagcttcccgatatccgacggtagtgtagtgatccgtctacatga

SEQ ID NO: 3088 - DNA, 70 bp, Artificial Sequence
  Description of Artificial Sequence: Synthetic probe
caagttgtgacacagctcttcagcttcccgatatccgacggtagtgttgacttgtgagcctcaatagtat

SEQ ID NO: 3089 - DNA, 70 bp, Artificial Sequence
  Description of Artificial Sequence: Synthetic probe
aaagatgtttttatggctctcacttcagcttcccgatatccgacggtagtgtaaagggcatcacaacttg

SEQ ID NO: 3090 - DNA, 70 bp, Artificial Sequence
  Description of Artificial Sequence: Synthetic probe
ctattaaatacttaaaaacatcacttcagcttcccgatatccgacggtagtgttcctgtcttctgagact

SEQ ID NO: 3091 - DNA, 70 bp, Artificial Sequence
  Description of Artificial Sequence: Synthetic probe
ggccaaacaacactaacctaccttcagcttcccgatatccgacggtagtgttttcccctgctttgttgaa

SEQ ID NO: 3092 - DNA, 70 bp, Artificial Sequence
  Description of Artificial Sequence: Synthetic probe
tttttcaagttctgctaagtcttcagcttcccgatatccgacggtagtgtagttccctcgacaatattgt

SEQ ID NO: 3093 - DNA, 70 bp, Artificial Sequence
  Description of Artificial Sequence: Synthetic probe
acgtgtctgaggatgcctcttcagcttcccgatatccgacggtagtgtaactccccttgttttgttcaga

SEQ ID NO: 3094 - DNA, 70 bp, Artificial Sequence
  Description of Artificial Sequence: Synthetic probe
ctctctgagggtctgtcttcagcttcccgatatccgacggtagtgtgtgatttccatatttgttacttct

SEQ ID NO: 3095 - DNA, 70 bp, Artificial Sequence
  Description of Artificial Sequence: Synthetic probe
ggcatagtagctttcatgccttcagcttcccgatatccgacggtagtgtactatttttttaatgttttct

SEQ ID NO: 3096 - DNA, 70 bp, Artificial Sequence
  Description of Artificial Sequence: Synthetic probe
gtgggtgagttgtcattcccttcagcttcccgatatccgacggtagtgtatttctaaacagttaagctca

SEQ ID NO: 3097 - DNA, 70 bp, Artificial Sequence
  Description of Artificial Sequence: Synthetic probe
ttaaattataataatctcaaagaacttcagcttcccgatatccgacggtagtgtactggacctgcaccac

SEQ ID NO: 3098 - DNA, 70 bp, Artificial Sequence
  Description of Artificial Sequence: Synthetic probe
tcaccactattcgcactcttcagcttcccgatatccgacggtagtgtattttaaaggaatcatttataaa

SEQ ID NO: 3099 - DNA, 70 bp, Artificial Sequence
  Description of Artificial Sequence: Synthetic probe
gataatagtgcccacttcttcagcttcccgatatccgacggtagtgttttattgtatatagttagataca

SEQ ID NO: 3100 - DNA, 70 bp, Artificial Sequence
  Description of Artificial Sequence: Synthetic probe
atgcactggacctgcacccttcagcttcccgatatccgacggtagtgtatcaacagaaaggacagagaga

SEQ ID NO: 3101 - DNA, 70 bp, Artificial Sequence
  Description of Artificial Sequence: Synthetic probe
agtgtatgttcatcggtggccttcagcttcccgatatccgacggtagtgtaatagaaactgacctcattc

SEQ ID NO: 3102 - DNA, 70 bp, Artificial Sequence
  Description of Artificial Sequence: Synthetic probe
tgtagaaattgcatcttttcttcagcttcccgatatccgacggtagtgttggcatagtagctttcatgct

SEQ ID NO: 3103 - DNA, 70 bp, Artificial Sequence
  Description of Artificial Sequence: Synthetic probe
ctaattaaaaacaaagcttctcttcagcttcccgatatccgacggtagtgttgggtgagttgtcattcct

SEQ ID NO: 3104 - DNA, 70 bp, Artificial Sequence
  Description of Artificial Sequence: Synthetic probe
actgtcaaagcactcgttcacttcagcttcccgatatccgacggtagtgttcaccactattcgcacttca

SEQ ID NO: 3105 - DNA, 70 bp, Artificial Sequence
  Description of Artificial Sequence: Synthetic probe
tacatttttctattcttgttcttcagcttcccgatatccgacggtagtgtgataatagtgcccacttttt

SEQ ID NO: 3106 - DNA, 70 bp, Artificial Sequence
  Description of Artificial Sequence: Synthetic probe
ggatcatctggattatactgcttcagcttcccgatatccgacggtagtgtaataattcaattttgagaca

SEQ ID NO: 3107 - DNA, 70 bp, Artificial Sequence
  Description of Artificial Sequence: Synthetic probe
catactctatctgtccacttcagcttcccgatatccgacggtagtgttttaaataatagtatcattacta

SEQ ID NO: 3108 - DNA, 70 bp, Artificial Sequence
  Description of Artificial Sequence: Synthetic probe
atcatctatatctgtagctcttcagcttcccgatatccgacggtagtgtggttctggaagttactgaata

SEQ ID NO: 3109 - DNA, 70 bp, Artificial Sequence
  Description of Artificial Sequence: Synthetic probe
tctcctgaaaatcctgtgcttcagcttcccgatatccgacggtagtgtcaataactatcagctgaaaaaa

SEQ ID NO: 3110 - DNA, 70 bp, Artificial Sequence
  Description of Artificial Sequence: Synthetic probe
tggtaccaactggagtcttcagcttcccgatatccgacggtagtgtcattaattttattccttttaagaa

SEQ ID NO: 3111 - DNA, 70 bp, Artificial Sequence
  Description of Artificial Sequence: Synthetic probe
ggaaaaaagattttaaatatcacttcagcttcccgatatccgacggtagtgtttgcaaataggtatttac

SEQ ID NO: 3112 - DNA, 70 bp, Artificial Sequence
  Description of Artificial Sequence: Synthetic probe
ttcattttatcaactgcaccttcagcttcccgatatccgacggtagtgtcggatcatctggattatactg

SEQ ID NO: 3113 - DNA, 70 bp, Artificial Sequence
  Description of Artificial Sequence: Synthetic probe
aatgttacagcataaaaatcagccttcagcttcccgatatccgacggtagtgtactctatctgtccattt

SEQ ID NO: 3114 - DNA, 70 bp, Artificial Sequence
  Description of Artificial Sequence: Synthetic probe
tttattacctaaaggaagacttcagcttcccgatatccgacggtagtgtcatcatctatatctgtagctc

SEQ ID NO: 3115 - DNA, 70 bp, Artificial Sequence
  Description of Artificial Sequence: Synthetic probe
ttggcagcccacaaccacttcagcttcccgatatccgacggtagtgtttgtctcctgaaaatcctgtgaa

SEQ ID NO: 3116 - DNA, 70 bp, Artificial Sequence
  Description of Artificial Sequence: Synthetic probe
tatgacaaagtagcgagtcttcttcagcttcccgatatccgacggtagtgtatataaacaccaagggcag

SEQ ID NO: 3117 - DNA, 70 bp, Artificial Sequence
  Description of Artificial Sequence: Synthetic probe
tcatagttgagcctcttcccttcagcttcccgatatccgacggtagtgtgccctgatgaagaagtgagtg

SEQ ID NO: 3118 - DNA, 70 bp, Artificial Sequence
  Description of Artificial Sequence: Synthetic probe
ctatatttccagtcaacattcttcagcttcccgatatccgacggtagtgtgagctctccaagagtatctg

SEQ ID NO: 3119 - DNA, 70 bp, Artificial Sequence
  Description of Artificial Sequence: Synthetic probe
aatttcaaaggtgtcattggcttcagcttcccgatatccgacggtagtgtttttggatgagttttttact

SEQ ID NO: 3120 - DNA, 70 bp, Artificial Sequence
  Description of Artificial Sequence: Synthetic probe
tgcaaatattaaagatacagacttcagcttcccgatatccgacggtagtgtattcacagaagaaatttaa

SEQ ID NO: 3121 - DNA, 70 bp, Artificial Sequence
  Description of Artificial Sequence: Synthetic probe
agattatttgaatgtaagatgacttcagcttcccgatatccgacggtagtgttgaatactcacattagct

SEQ ID NO: 3122 - DNA, 70 bp, Artificial Sequence
  Description of Artificial Sequence: Synthetic probe
aataactcaatattttggattcttcagcttcccgatatccgacggtagtgtatgacaaagtagcgagtct

SEQ ID NO: 3123 - DNA, 70 bp, Artificial Sequence
  Description of Artificial Sequence: Synthetic probe
ctcttggaagttagagatgacttcagcttcccgatatccgacggtagtgttcatagttgagcctcttcct

SEQ ID NO: 3124 - DNA, 70 bp, Artificial Sequence
  Description of Artificial Sequence: Synthetic probe
ttatcatctgaaaatagaatgactcttcagcttcccgatatccgacggtagtgtatttccagtcaacatt

SEQ ID NO: 3125 - DNA, 70 bp, Artificial Sequence
  Description of Artificial Sequence: Synthetic probe
taagcttcagagtcaatcttcagcttcccgatatccgacggtagtgtgggaatttcaaaggtgtcattgg

SEQ ID NO: 3126 - DNA, 70 bp, Artificial Sequence
  Description of Artificial Sequence: Synthetic probe
tcaactcaggtatggcagcttgatacttcagcttcccgatatccgacggtagtgttttcggacataaata

SEQ ID NO: 3127 - DNA, 70 bp, Artificial Sequence
  Description of Artificial Sequence: Synthetic probe
agtgagtggacggcaacttcagcttcccgatatccgacggtagtgtttttcaatgtgcatatactgagtt

SEQ ID NO: 3128 - DNA, 70 bp, Artificial Sequence
  Description of Artificial Sequence: Synthetic probe
ctttgggaggccaaggtgcttcagcttcccgatatccgacggtagtgttccagaacatccactgtgagag

SEQ ID NO: 3129 - DNA, 70 bp, Artificial Sequence
  Description of Artificial Sequence: Synthetic probe
cacttgaggtcaggggtttcttcagcttcccgatatccgacggtagtgtggtggtggttcgcctctcatt

SEQ ID NO: 3130 - DNA, 70 bp, Artificial Sequence
  Description of Artificial Sequence: Synthetic probe
tttggcacaaggacaccttcagcttcccgatatccgacggtagtgttgctattataaattatatgtctac

SEQ ID NO: 3131 - DNA, 70 bp, Artificial Sequence
  Description of Artificial Sequence: Synthetic probe
acattggacccaagtcatctcttcagcttcccgatatccgacggtagtgtacttgaacatgatcccattg

SEQ ID NO: 3132 - DNA, 70 bp, Artificial Sequence
  Description of Artificial Sequence: Synthetic probe
cagaacatccactgtgagacttcagcttcccgatatccgacggtagtgtttaaaacatgcaaataaatgg

SEQ ID NO: 3133 - DNA, 70 bp, Artificial Sequence
  Description of Artificial Sequence: Synthetic probe
gtggtggttcgcctccttcagcttcccgatatccgacggtagtgtagaaagataagagtatatttaccgg

SEQ ID NO: 3134 - DNA, 70 bp, Artificial Sequence
  Description of Artificial Sequence: Synthetic probe
tttgggcacggtcctgtcttcagcttcccgatatccgacggtagtgtttctcaactcaggtatggcagct

SEQ ID NO: 3135 - DNA, 70 bp, Artificial Sequence
  Description of Artificial Sequence: Synthetic probe
aaaacaaacaacaggtagcttcagcttcccgatatccgacggtagtgttaagtgagtggacggcaatcac

SEQ ID NO: 3136 - DNA, 70 bp, Artificial Sequence
  Description of Artificial Sequence: Synthetic probe
aaattaggcacaatagccaggacttcagcttcccgatatccgacggtagtgttggcacaaggacacaagg

SEQ ID NO: 3137 - DNA, 70 bp, Artificial Sequence
  Description of Artificial Sequence: Synthetic probe
gtggcccatacctgtaatcccttcagcttcccgatatccgacggtagtgtacattggacccaagtcatct

SEQ ID NO: 3138 - DNA, 70 bp, Artificial Sequence
  Description of Artificial Sequence: Synthetic probe
aaggatggaatagaggattcccttcagcttcccgatatccgacggtagtgtatttttaaaatgtgtttat

SEQ ID NO: 3139 - DNA, 70 bp, Artificial Sequence
  Description of Artificial Sequence: Synthetic probe
ctatctgatggcggttgcttcagcttcccgatatccgacggtagtgtacaaaagtaacaatcatgtcaaa

SEQ ID NO: 3140 - DNA, 70 bp, Artificial Sequence
  Description of Artificial Sequence: Synthetic probe
ggtcctgatcaatggccttcagcttcccgatatccgacggtagtgtaataaactttgttatttaaaatat

SEQ ID NO: 3141 - DNA, 70 bp, Artificial Sequence
  Description of Artificial Sequence: Synthetic probe
tggcgtaacaataatggggcttcagcttcccgatatccgacggtagtgtttggaattgagagaatttgtt

SEQ ID NO: 3142 - DNA, 70 bp, Artificial Sequence
  Description of Artificial Sequence: Synthetic probe
tcttcctgaaaaaaaaacttcagcttcccgatatccgacggtagtgttgtaagattctagaataactgat

SEQ ID NO: 3143 - DNA, 70 bp, Artificial Sequence
  Description of Artificial Sequence: Synthetic probe
gtttcattcagccgcacttcagcttcccgatatccgacggtagtgtgtgtaaaatgttatcagatacaaa

SEQ ID NO: 3144 - DNA, 70 bp, Artificial Sequence
  Description of Artificial Sequence: Synthetic probe
cttcatgaaggattgagacttcagcttcccgatatccgacggtagtgtacaaggatggaatagaggattc

SEQ ID NO: 3145 - DNA, 70 bp, Artificial Sequence
  Description of Artificial Sequence: Synthetic probe
tttagtttggaaatctatataaccttcagcttcccgatatccgacggtagtgttctgatggcggttgaat

SEQ ID NO: 3146 - DNA, 70 bp, Artificial Sequence
  Description of Artificial Sequence: Synthetic probe
ctgagacagtaaactcaagtcttcagcttcccgatatccgacggtagtgtggtcctgatcaatggcttgg

SEQ ID NO: 3147 - DNA, 70 bp, Artificial Sequence
  Description of Artificial Sequence: Synthetic probe
catttatgatctaatacctttcttcagcttcccgatatccgacggtagtgtggcgtaacaataatggggt

SEQ ID NO: 3148 - DNA, 70 bp, Artificial Sequence
  Description of Artificial Sequence: Synthetic probe
ttctggtgaaagtctctgtcttcagcttcccgatatccgacggtagtgtaacaaaaaattgactgactgc

SEQ ID NO: 3149 - DNA, 70 bp, Artificial Sequence
  Description of Artificial Sequence: Synthetic probe
gctccaggagactaagttctcttcagcttcccgatatccgacggtagtgtacattaattttaattttata

SEQ ID NO: 3150 - DNA, 70 bp, Artificial Sequence
  Description of Artificial Sequence: Synthetic probe
cctaggatgcatatggaaaaacttcagcttcccgatatccgacggtagtgtaactgcctacagtagcgtc

SEQ ID NO: 3151 - DNA, 70 bp, Artificial Sequence
  Description of Artificial Sequence: Synthetic probe
gggtaatcctcaggagtcttcagcttcccgatatccgacggtagtgtcagatttatctgattagcagttc

SEQ ID NO: 3152 - DNA, 70 bp, Artificial Sequence
  Description of Artificial Sequence: Synthetic probe
gacattgagatttcagtaccttcagcttcccgatatccgacggtagtgtacacaaggaaataagatatta

SEQ ID NO: 3153 - DNA, 70 bp, Artificial Sequence
  Description of Artificial Sequence: Synthetic probe
gagaacaataagtaatatgtgcttcagcttcccgatatccgacggtagtgttttaccttaataaccaaat

SEQ ID NO: 3154 - DNA, 70 bp, Artificial Sequence
  Description of Artificial Sequence: Synthetic probe
tgctttttctatttcccttcacttcagcttcccgatatccgacggtagtgttctggtgaaagtctctgtt

SEQ ID NO: 3155 - DNA, 70 bp, Artificial Sequence
  Description of Artificial Sequence: Synthetic probe
ctgaggaacaaagctacaacttcagcttcccgatatccgacggtagtgtggctccaggagactaagttct

SEQ ID NO: 3156 - DNA, 70 bp, Artificial Sequence
  Description of Artificial Sequence: Synthetic probe
tagtaaattaagtttcacaacttcagcttcccgatatccgacggtagtgtcctaggatgcatatggaaaa

SEQ ID NO: 3157 - DNA, 70 bp, Artificial Sequence
  Description of Artificial Sequence: Synthetic probe
actgctccgcggccggcttcagcttcccgatatccgacggtagtgtctctggcggagtgacgctccgtag

SEQ ID NO: 3158 - DNA, 70 bp, Artificial Sequence
  Description of Artificial Sequence: Synthetic probe
gattacccttctctgtagtcggctgcttcagcttcccgatatccgacggtagtgtgccggacctggggca

SEQ ID NO: 3159 - DNA, 70 bp, Artificial Sequence
  Description of Artificial Sequence: Synthetic probe
agcgccagcgccagcgccttcagcttcccgatatccgacggtagtgtcagattgggcaggtgaggttccc

SEQ ID NO: 3160 - DNA, 70 bp, Artificial Sequence
  Description of Artificial Sequence: Synthetic probe
gtcagacagagccagcgcccttcagcttcccgatatccgacggtagtgttgatggcggtgaatagacctt

SEQ ID NO: 3161 - DNA, 70 bp, Artificial Sequence
  Description of Artificial Sequence: Synthetic probe
ctgccggagcccagagaacccttcagcttcccgatatccgacggtagtgtcagtgctcaccttcagcccg

SEQ ID NO: 3162 - DNA, 70 bp, Artificial Sequence
  Description of Artificial Sequence: Synthetic probe
ccttggggagaaagagggtgagccttcagcttcccgatatccgacggtagtgtgcctcctccactgcagc

SEQ ID NO: 3163 - DNA, 70 bp, Artificial Sequence
  Description of Artificial Sequence: Synthetic probe
tatgcgatgtaacctggcaggatggcttcagcttcccgatatccgacggtagtgtccccagccccagcac

SEQ ID NO: 3164 - DNA, 70 bp, Artificial Sequence
  Description of Artificial Sequence: Synthetic probe
caaagacatctcggagccggggcttcagcttcccgatatccgacggtagtgtagcccagcgcaccagcat

SEQ ID NO: 3165 - DNA, 70 bp, Artificial Sequence
  Description of Artificial Sequence: Synthetic probe
attgggcaggtgaggttccccttcagcttcccgatatccgacggtagtgtcaccctctccatcagggatg

SEQ ID NO: 3166 - DNA, 70 bp, Artificial Sequence
  Description of Artificial Sequence: Synthetic probe
gatggcggtgaatagacccttcagcttcccgatatccgacggtagtgtgcaaactcagtgatggattgta

SEQ ID NO: 3167 - DNA, 70 bp, Artificial Sequence
  Description of Artificial Sequence: Synthetic probe
gccccgggcggcgcccttcagcttcccgatatccgacggtagtgtggggctccggcggtcccgtcttgtc

SEQ ID NO: 3168 - DNA, 70 bp, Artificial Sequence
  Description of Artificial Sequence: Synthetic probe
gcctggaccctagccagccccttcagcttcccgatatccgacggtagtgtggcccatccaaaggagtccg

SEQ ID NO: 3169 - DNA, 70 bp, Artificial Sequence
  Description of Artificial Sequence: Synthetic probe
tggttcgtctgtcccgtcccccccttcagcttcccgatatccgacggtagtgtgccagcgccagcgccag

SEQ ID NO: 3170 - DNA, 70 bp, Artificial Sequence
  Description of Artificial Sequence: Synthetic probe
cattgtcgcgcttcctacacggcttcagcttcccgatatccgacggtagtgtcagacagagccagcgcca

SEQ ID NO: 3171 - DNA, 70 bp, Artificial Sequence
  Description of Artificial Sequence: Synthetic probe
ggcggagtgacgctccgtagcttcagcttcccgatatccgacggtagtgtctgccggagcccagagaacc

SEQ ID NO: 3172 - DNA, 70 bp, Artificial Sequence
  Description of Artificial Sequence: Synthetic probe
tcccggccggacctggggcagctcttcagcttcccgatatccgacggtagtgttggggagaaagagggtg

SEQ ID NO: 3173 - DNA, 70 bp, Artificial Sequence
  Description of Artificial Sequence: Synthetic probe
tccggcggtcccgtcttcttcagcttcccgatatccgacggtagtgtcactatgcgatgtaacctggcag

SEQ ID NO: 3174 - DNA, 70 bp, Artificial Sequence
  Description of Artificial Sequence: Synthetic probe
ggcccatccaaaggagtccggcttcagcttcccgatatccgacggtagtgtaaagacatctcggagccgg

SEQ ID NO: 3175 - DNA, 70 bp, Artificial Sequence
  Description of Artificial Sequence: Synthetic probe
tcagtgcacacctttgccttccacttcagcttcccgatatccgacggtagtgtcgcgagccacattgggt

SEQ ID NO: 3176 - DNA, 70 bp, Artificial Sequence
  Description of Artificial Sequence: Synthetic probe
ctgggcaggactcagtgcacccttcagcttcccgatatccgacggtagtgttgcacagcttgatggccac

SEQ ID NO: 3177 - DNA, 70 bp, Artificial Sequence
  Description of Artificial Sequence: Synthetic probe
cacacctccaccatgtcatcctcaacttcagcttcccgatatccgacggtagtgttggggctggggggct

SEQ ID NO: 3178 - DNA, 70 bp, Artificial Sequence
  Description of Artificial Sequence: Synthetic probe
agatgggctcagcactgagcgcttcagcttcccgatatccgacggtagtgtaggaagaggatgcggctga

SEQ ID NO: 3179 - DNA, 70 bp, Artificial Sequence
  Description of Artificial Sequence: Synthetic probe
agcccaggagcaggccacttcagcttcccgatatccgacggtagtgtggtagtcatgatcccagtgcagg

SEQ ID NO: 3180 - DNA, 70 bp, Artificial Sequence
  Description of Artificial Sequence: Synthetic probe
aaaatgtcccagtgcccacaggtcttcagcttcccgatatccgacggtagtgttcagggtccgtgccctc

SEQ ID NO: 3181 - DNA, 70 bp, Artificial Sequence
  Description of Artificial Sequence: Synthetic probe
aggcaaagagatgttccaagatgacttcagcttcccgatatccgacggtagtgtcggcagcacagtgggt

SEQ ID NO: 3182 - DNA, 70 bp, Artificial Sequence
  Description of Artificial Sequence: Synthetic probe
gtttggggggcggcttcggcacagtcttcagcttcccgatatccgacggtagtgtgcgggcggcaggcca

SEQ ID NO: 3183 - DNA, 70 bp, Artificial Sequence
  Description of Artificial Sequence: Synthetic probe
gcacctggggctgggggcttcagcttcccgatatccgacggtagtgttattcgccccagtatccggcacc

SEQ ID NO: 3184 - DNA, 70 bp, Artificial Sequence
  Description of Artificial Sequence: Synthetic probe
gaggaagaggatgcggctgacacttcagcttcccgatatccgacggtagtgtggggcaggtcacacttgc

SEQ ID NO: 3185 - DNA, 70 bp, Artificial Sequence
  Description of Artificial Sequence: Synthetic probe
agtcatgatcccagtgcaggtcttcagcttcccgatatccgacggtagtgtactcaacaggctctccagg

SEQ ID NO: 3186 - DNA, 70 bp, Artificial Sequence
  Description of Artificial Sequence: Synthetic probe
cagtcagggtccgtgccctccacttcagcttcccgatatccgacggtagtgtaaaagggccggctgggcc

SEQ ID NO: 3187 - DNA, 70 bp, Artificial Sequence
  Description of Artificial Sequence: Synthetic probe
ttgggcctccatttccaaaccttcagcttcccgatatccgacggtagtgtggcaggtggtgctatcttca

SEQ ID NO: 3188 - DNA, 70 bp, Artificial Sequence
  Description of Artificial Sequence: Synthetic probe
ccggcggcagcacagtgcttcagcttcccgatatccgacggtagtgtggggatgtctcctgtccagtaca

SEQ ID NO: 3189 - DNA, 70 bp, Artificial Sequence
  Description of Artificial Sequence: Synthetic probe
gggatgcgggcggcaggcttcagcttcccgatatccgacggtagtgtgagtctggtgccagacatcatgt

SEQ ID NO: 3190 - DNA, 70 bp, Artificial Sequence
  Description of Artificial Sequence: Synthetic probe
tcgccccagtatccggcacctgcttcagcttcccgatatccgacggtagtgtggcccgcagttggtcctg

SEQ ID NO: 3191 - DNA, 70 bp, Artificial Sequence
  Description of Artificial Sequence: Synthetic probe
caggggcaggtcacacttgccttcagcttcccgatatccgacggtagtgtcctcacaagtgctgtgacgg

SEQ ID NO: 3192 - DNA, 70 bp, Artificial Sequence
  Description of Artificial Sequence: Synthetic probe
cactcaacaggctctccagggtccttcagcttcccgatatccgacggtagtgtctggcactggccccagg

SEQ ID NO: 3193 - DNA, 70 bp, Artificial Sequence
  Description of Artificial Sequence: Synthetic probe
tcaaaagggccggctgggcttcagcttcccgatatccgacggtagtgttgctttcatggttacccacagc

SEQ ID NO: 3194 - DNA, 70 bp, Artificial Sequence
  Description of Artificial Sequence: Synthetic probe
gatgtctcctgtccagtacacttcagcttcccgatatccgacggtagtgtgggagggaagctattgacag

SEQ ID NO: 3195 - DNA, 70 bp, Artificial Sequence
  Description of Artificial Sequence: Synthetic probe
tctggtgccagacatcatgtgcttcagcttcccgatatccgacggtagtgtggagtggttgccctcaatg

SEQ ID NO: 3196 - DNA, 70 bp, Artificial Sequence
  Description of Artificial Sequence: Synthetic probe
agggcccgcagttggtcccttcagcttcccgatatccgacggtagtgttggccatcgcttcatagagcca

SEQ ID NO: 3197 - DNA, 70 bp, Artificial Sequence
  Description of Artificial Sequence: Synthetic probe
cctcacaagtgctgtgacggtgcttcagcttcccgatatccgacggtagtgtgcagccagggctcccaag

SEQ ID NO: 3198 - DNA, 70 bp, Artificial Sequence
  Description of Artificial Sequence: Synthetic probe
caggccaacccctggcccttcagcttcccgatatccgacggtagtgtcaaagaggtggacaatggattgg

SEQ ID NO: 3199 - DNA, 70 bp, Artificial Sequence
  Description of Artificial Sequence: Synthetic probe
acactggcactggccccaggaacttcagcttcccgatatccgacggtagtgtctgagggtgcgcagggct

SEQ ID NO: 3200 - DNA, 70 bp, Artificial Sequence
  Description of Artificial Sequence: Synthetic probe
ctttcatggttaccccttcagcttcccgatatccgacggtagtgttcccttcctgggtttccacggacga

SEQ ID NO: 3201 - DNA, 70 bp, Artificial Sequence
  Description of Artificial Sequence: Synthetic probe
gggagggaagctattgacacttcagcttcccgatatccgacggtagtgtcactttcattcacctttcttt

SEQ ID NO: 3202 - DNA, 70 bp, Artificial Sequence
  Description of Artificial Sequence: Synthetic probe
aggagtggttgccctcaatgacttcagcttcccgatatccgacggtagtgttgccccaggttcccttctc

SEQ ID NO: 3203 - DNA, 70 bp, Artificial Sequence
  Description of Artificial Sequence: Synthetic probe
gccatcgcttcatagagccacttcagcttcccgatatccgacggtagtgtactcatgctagagcaatcag

SEQ ID NO: 3204 - DNA, 70 bp, Artificial Sequence
  Description of Artificial Sequence: Synthetic probe
aggcagccagggctcccacttcagcttcccgatatccgacggtagtgtaggggagccaaatgaagagcac

SEQ ID NO: 3205 - DNA, 70 bp, Artificial Sequence
  Description of Artificial Sequence: Synthetic probe
acctgagggtgcgcagggcttcagcttcccgatatccgacggtagtgttagaaagggaaggaggagtcag

SEQ ID NO: 3206 - DNA, 70 bp, Artificial Sequence
  Description of Artificial Sequence: Synthetic probe
tcctgggtttccacggacgacttcagcttcccgatatccgacggtagtgtaaaagcctggtgcggcaaaa

SEQ ID NO: 3207 - DNA, 70 bp, Artificial Sequence
  Description of Artificial Sequence: Synthetic probe
gaaatcagaggcagagcagagcttcagcttcccgatatccgacggtagtgtacacctccaccatgtcatc

SEQ ID NO: 3208 - DNA, 70 bp, Artificial Sequence
  Description of Artificial Sequence: Synthetic probe
ctgcagtgggaggagcgcacttcagcttcccgatatccgacggtagtgtcagatgggctcagcactgagc

SEQ ID NO: 3209 - DNA, 70 bp, Artificial Sequence
  Description of Artificial Sequence: Synthetic probe
ccacgcgagccacattgggttccttcagcttcccgatatccgacggtagtgtcccaggagcaggccacag

SEQ ID NO: 3210 - DNA, 70 bp, Artificial Sequence
  Description of Artificial Sequence: Synthetic probe
ttgcacagcttgatggccacgcttcagcttcccgatatccgacggtagtgtaaatgtcccagtgcccaca

SEQ ID NO: 3211 - DNA, 70 bp, Artificial Sequence
  Description of Artificial Sequence: Synthetic probe
ggcaggtggtgctatcttcacttcagcttcccgatatccgacggtagtgtaggcaaagagatgttccaag

SEQ ID NO: 3212 - DNA, 70 bp, Artificial Sequence
  Description of Artificial Sequence: Synthetic probe
agaggtggacaatggattggcacaccttcagcttcccgatatccgacggtagtgtgggggcggcttcggc

SEQ ID NO: 3213 - DNA, 70 bp, Artificial Sequence
  Description of Artificial Sequence: Synthetic probe
gaatgccaggaaaataaaactcttcagcttcccgatatccgacggtagtgtatgtggccaattatatgca

SEQ ID NO: 3214 - DNA, 70 bp, Artificial Sequence
  Description of Artificial Sequence: Synthetic probe
tgaatccccagggaacacttgcttcagcttcccgatatccgacggtagtgtgctcttcagacagtgccct

SEQ ID NO: 3215 - DNA, 70 bp, Artificial Sequence
  Description of Artificial Sequence: Synthetic probe
aaggctttcaacagtgaccacttcagcttcccgatatccgacggtagtgtacaattcggtaataattcca

SEQ ID NO: 3216 - DNA, 70 bp, Artificial Sequence
  Description of Artificial Sequence: Synthetic probe
tggctagagaaagggggactgcttcagcttcccgatatccgacggtagtgtccctcatctccgtcctacc

SEQ ID NO: 3217 - DNA, 70 bp, Artificial Sequence
  Description of Artificial Sequence: Synthetic probe
gggcatccaggggtccaggcttcagcttcccgatatccgacggtagtgtcagacactcaccctgtcccta

SEQ ID NO: 3218 - DNA, 70 bp, Artificial Sequence
  Description of Artificial Sequence: Synthetic probe
tagggagaattaaggatggtacttcagcttcccgatatccgacggtagtgttgctcaagggaattttcag

SEQ ID NO: 3219 - DNA, 70 bp, Artificial Sequence
  Description of Artificial Sequence: Synthetic probe
aatgtggccaattatatgcacccttcagcttcccgatatccgacggtagtgtcatgggacaacagggatg

SEQ ID NO: 3220 - DNA, 70 bp, Artificial Sequence
  Description of Artificial Sequence: Synthetic probe
agctcttcagacagtgccccttcagcttcccgatatccgacggtagtgtcctgttctagtgaggagcctc

SEQ ID NO: 3221 - DNA, 70 bp, Artificial Sequence
  Description of Artificial Sequence: Synthetic probe
acaattcggtaataattccagctccttcagcttcccgatatccgacggtagtgtaggatgccctctttct

SEQ ID NO: 3222 - DNA, 70 bp, Artificial Sequence
  Description of Artificial Sequence: Synthetic probe
tgagatgctcaagggaatttcttcagcttcccgatatccgacggtagtgtgcagccagggtgttctcata

SEQ ID NO: 3223 - DNA, 70 bp, Artificial Sequence
  Description of Artificial Sequence: Synthetic probe
ccactccatgggacaacagggcttcagcttcccgatatccgacggtagtgtacatgagtgtggccaaaga

SEQ ID NO: 3224 - DNA, 70 bp, Artificial Sequence
  Description of Artificial Sequence: Synthetic probe
tgcactgggtgccaggaaggctacacttcagcttcccgatatccgacggtagtgtcaagggtaactccag

SEQ ID NO: 3225 - DNA, 70 bp, Artificial Sequence
  Description of Artificial Sequence: Synthetic probe
caacctgttctagtgaggacttcagcttcccgatatccgacggtagtgttcatcatagaagacctcaaat

SEQ ID NO: 3226 - DNA, 70 bp, Artificial Sequence
  Description of Artificial Sequence: Synthetic probe
ggggagataggatgccctctttctcttcagcttcccgatatccgacggtagtgtgcggccggctcagagt

SEQ ID NO: 3227 - DNA, 70 bp, Artificial Sequence
  Description of Artificial Sequence: Synthetic probe
tctagggaggggtaggaagacacttcagcttcccgatatccgacggtagtgtcactgggtgccaggaagg

SEQ ID NO: 3228 - DNA, 70 bp, Artificial Sequence
  Description of Artificial Sequence: Synthetic probe
ccagaaggtactacattcagacttcagcttcccgatatccgacggtagtgtaggattaaggccgatgtag

SEQ ID NO: 3229 - DNA, 70 bp, Artificial Sequence
  Description of Artificial Sequence: Synthetic probe
gcagccagggtgttctcatacccttcagcttcccgatatccgacggtagtgtaggctcccttctgcctca

SEQ ID NO: 3230 - DNA, 70 bp, Artificial Sequence
  Description of Artificial Sequence: Synthetic probe
cacatgagtgtggccaaagaactgcttcagcttcccgatatccgacggtagtgttcccaccaactccagg

SEQ ID NO: 3231 - DNA, 70 bp, Artificial Sequence
  Description of Artificial Sequence: Synthetic probe
catcatagaagacctcaaattcacttcagcttcccgatatccgacggtagtgtgctctggctccaacctc

SEQ ID NO: 3232 - DNA, 70 bp, Artificial Sequence
  Description of Artificial Sequence: Synthetic probe
gccagcggccggctcagagcttcagcttcccgatatccgacggtagtgtgggccacacatcctgcccatg

SEQ ID NO: 3233 - DNA, 70 bp, Artificial Sequence
  Description of Artificial Sequence: Synthetic probe
tccaggataagggaggctcccttcagcttcccgatatccgacggtagtgtagtttccatctatttggtac

SEQ ID NO: 3234 - DNA, 70 bp, Artificial Sequence
  Description of Artificial Sequence: Synthetic probe
aacctccttcccctatcccacccttcagcttcccgatatccgacggtagtgtgaccacgtgagagctccc

SEQ ID NO: 3235 - DNA, 70 bp, Artificial Sequence
  Description of Artificial Sequence: Synthetic probe
tagagaagctgccagtgcggtatgcttcagcttcccgatatccgacggtagtgttgccacagggctccga

SEQ ID NO: 3236 - DNA, 70 bp, Artificial Sequence
  Description of Artificial Sequence: Synthetic probe
cagcccataggtttctcgagccttcagcttcccgatatccgacggtagtgtgcacaaagagtagccagac

SEQ ID NO: 3237 - DNA, 70 bp, Artificial Sequence
  Description of Artificial Sequence: Synthetic probe
gccaggcggtaggcagtgtgtcttcagcttcccgatatccgacggtagtgtgctgtcagcacgggcagag

SEQ ID NO: 3238 - DNA, 70 bp, Artificial Sequence
  Description of Artificial Sequence: Synthetic probe
ccccgcatgcgatataccaggtcttcagcttcccgatatccgacggtagtgtcatcaggtggcggcacag

SEQ ID NO: 3239 - DNA, 70 bp, Artificial Sequence
  Description of Artificial Sequence: Synthetic probe
gaaggtctggaaaagttgcatgtcttcagcttcccgatatccgacggtagtgtggcctctgggaggctcc

SEQ ID NO: 3240 - DNA, 70 bp, Artificial Sequence
  Description of Artificial Sequence: Synthetic probe
ggtggcccttatggtagagaaaccttcagcttcccgatatccgacggtagtgtacagtggccttggccac

SEQ ID NO: 3241 - DNA, 70 bp, Artificial Sequence
  Description of Artificial Sequence: Synthetic probe
ggcgtgccacagggctccttcagcttcccgatatccgacggtagtgttcccaaatgtgggccctggggcc

SEQ ID NO: 3242 - DNA, 70 bp, Artificial Sequence
  Description of Artificial Sequence: Synthetic probe
ggcacaaagagtagccagacgcttcagcttcccgatatccgacggtagtgtcctttcctacatcaagaac

SEQ ID NO: 3243 - DNA, 70 bp, Artificial Sequence
  Description of Artificial Sequence: Synthetic probe
ggctgtcagcacgggcagacttcagcttcccgatatccgacggtagtgtaccacagcagcatttgggctt

SEQ ID NO: 3244 - DNA, 70 bp, Artificial Sequence
  Description of Artificial Sequence: Synthetic probe
ggcatcaggtggcggcacagagcagcttcagcttcccgatatccgacggtagtgtgatgatcttgcctgg

SEQ ID NO: 3245 - DNA, 70 bp, Artificial Sequence
  Description of Artificial Sequence: Synthetic probe
cccatgctttgcaggctccttcagcttcccgatatccgacggtagtgtagattcaggatgtaggtctcat

SEQ ID NO: 3246 - DNA, 70 bp, Artificial Sequence
  Description of Artificial Sequence: Synthetic probe
ctgggcctctgggaggctcccatcttcagcttcccgatatccgacggtagtgtggggcccagggactggt

SEQ ID NO: 3247 - DNA, 70 bp, Artificial Sequence
  Description of Artificial Sequence: Synthetic probe
aaaacagtggccttggccacacttcagcttcccgatatccgacggtagtgtagaaggtcctgtttccccg

SEQ ID NO: 3248 - DNA, 70 bp, Artificial Sequence
  Description of Artificial Sequence: Synthetic probe
ctccagggaggggccacacatcccttcagcttcccgatatccgacggtagtgtccggtatgtttgcctgg

SEQ ID NO: 3249 - DNA, 70 bp, Artificial Sequence
  Description of Artificial Sequence: Synthetic probe
ctggaggggcaaggacttcagcttcccgatatccgacggtagtgtccctgtagagaagctgccagtgcgg

SEQ ID NO: 3250 - DNA, 70 bp, Artificial Sequence
  Description of Artificial Sequence: Synthetic probe
gtaacctgcaaggatgtggggcttcagcttcccgatatccgacggtagtgtagcccataggtttctcgag

SEQ ID NO: 3251 - DNA, 70 bp, Artificial Sequence
  Description of Artificial Sequence: Synthetic probe
agtttccatctatttggtacacacgcttcagcttcccgatatccgacggtagtgtgcggtaggcagtgtg

SEQ ID NO: 3252 - DNA, 70 bp, Artificial Sequence
  Description of Artificial Sequence: Synthetic probe
aggaccacgtgagagctcccttcagcttcccgatatccgacggtagtgtgccccgcatgcgatataccag

SEQ ID NO: 3253 - DNA, 70 bp, Artificial Sequence
  Description of Artificial Sequence: Synthetic probe
attcaggatgtaggtctcatggcttcagcttcccgatatccgacggtagtgtaggtctggaaaagttgca

SEQ ID NO: 3254 - DNA, 70 bp, Artificial Sequence
  Description of Artificial Sequence: Synthetic probe
ctcccggtatgtttgcctggcttcagcttcccgatatccgacggtagtgtggtggcccttatggtagaga

SEQ ID NO: 3255 - DNA, 170 bp, Homo sapiens
cctactcttcatcaccttccccatcctcttcattggtgagtgcgcgcagcgagccgcggaggaggggacgggagagcagggagggaggaggaggcgctgcgcgccgcaccgctcggcgtccccttccggcccgcgaccgccgtccgcctcgttcccggggtcccctgccc

SEQ ID NO: 3256 - DNA, 170 bp, Homo sapiens
ctcaacgtggtgccgcacgtcttcctactcttcatcaccttccccatcctcttcattggtgagtgcgcgcagcgagccgcggaggaggggacgggagagcagggagggaggaggaggcgctgcgcgccgcaccgctcggcgtccccttccggcccgcgaccgccgtccgc

SEQ ID NO: 3257 - DNA, 170 bp, Homo sapiens
ggcggggcccggggggcgggggcctgacggccgggccgggcggcggagctgcaagggacagaggcgcggcaggcgcgcggagccagcggagccagctgagcccgagcccagcccgcgcccgcgccgccatgcccctggccttctgcggcagcgagaaccactcggccgcc

SEQ ID NO: 3258 - DNA, 170 bp, Homo sapiens
ctcaacaacggctgctttgtggacgcgctcaacgtggtgccgcacgtcttcctactcttcatcaccttccccatcctcttcattggtgagtgcgcgcagcgagccgcggaggaggggacgggagagcagggagggaggaggaggcgctgcgcgccgcaccgctcggcgtc

SEQ ID NO: 3259 - DNA, 170 bp, Homo sapiens
taccgggtggaccagggggtcctcaacaacggctgctttgtggacgcgctcaacgtggtgccgcacgtcttcctactcttcatcaccttccccatcctcttcattggtgagtgcgcgcagcgagccgcggaggaggggacgggagagcagggagggaggaggaggcgctg

SEQ ID NO: 3260 - DNA, 170 bp, Homo sapiens
ggcagcgagaaccactcggccgcctaccgggtggaccagggggtcctcaacaacggctgctttgtggacgcgctcaacgtggtgccgcacgtcttcctactcttcatcaccttccccatcctcttcattggtgagtgcgcgcagcgagccgcggaggaggggacgggaga

SEQ ID NO: 3261 - DNA, 170 bp, Homo sapiens
cgccatgcccctggccttctgcggcagcgagaaccactcggccgcctaccgggtggaccagggggtcctcaacaacggctgctttgtggacgcgctcaacgtggtgccgcacgtcttcctactcttcatcaccttccccatcctcttcattggtgagtgcgcgcagcgag

SEQ ID NO: 3262 - DNA, 170 bp, Homo sapiens
cccgagcccagcccgcgcccgcgccgccatgcccctggccttctgcggcagcgagaaccactcggccgcctaccgggtggaccagggggtcctcaacaacggctgctttgtggacgcgctcaacgtggtgccgcacgtcttcctactcttcatcaccttccccatcctct

SEQ ID NO: 3263 - DNA, 170 bp, Homo sapiens
cgcggagccagcggagccagctgagcccgagcccagcccgcgcccgcgccgccatgcccctggccttctgcggcagcgagaaccactcggccgcctaccgggtggaccagggggtcctcaacaacggctgctttgtggacgcgctcaacgtggtgccgcacgtcttccta

SEQ ID NO: 3264 - DNA, 170 bp, Homo sapiens
agctgcaagggacagaggcgcggcaggcgcgcggagccagcggagccagctgagcccgagcccagcccgcgcccgcgccgccatgcccctggccttctgcggcagcgagaaccactcggccgcctaccgggtggaccagggggtcctcaacaacggctgctttgtggacg

SEQ ID NO: 3265 - DNA, 170 bp, Homo sapiens
gacggccgggccgggcggcggagctgcaagggacagaggcgcggcaggcgcgcggagccagcggagccagctgagcccgagcccagcccgcgcccgcgccgccatgcccctggccttctgcggcagcgagaaccactcggccgcctaccgggtggaccagggggtcctca

SEQ ID NO: 3266 - DNA, 170 bp, Homo sapiens
ggcctttgccatctatacctccatctccagtgagttcaccccacacagccagccctgggtgctgctgcgtacatgcaaggagagggtgtcagagctcgggtaagagggggtgcagggacagaagcaggaggccttgagattatccgactcagtaggggagcctcaaactg

SEQ ID NO: 3267 - DNA, 170 bp, Homo sapiens
caggaaggagatgaccagcctcagggcctttgccatctatacctccatctccagtgagttcaccccacacagccagccctgggtgctgctgcgtacatgcaaggagagggtgtcagagctcgggtaagagggggtgcagggacagaagcaggaggccttgagattatccg

SEQ ID NO: 3268 - DNA, 170 bp, Homo sapiens
cctcccggtgaggacaggaggcgggcatggcagtgacagtattgacactcaggccttcctctcgggtgggagacggagcagaagcctctcccctctgactcggggacccctgcaggagtattccaatgagcggctgaagcagaccaacgagatgctccgcggcatcaagc

SEQ ID NO: 3269 - DNA, 170 bp, Homo sapiens
tggagtcaatgggggaggaggctgcctcccggtgaggacaggaggcgggcatggcagtgacagtattgacactcaggccttcctctcgggtgggagacggagcagaagcctctcccctctgactcggggacccctgcaggagtattccaatgagcggctgaagcagacca

SEQ ID NO: 3270 - DNA, 170 bp, Homo sapiens
gcacgcgggtggagacgacccgcaggaaggagatgaccagcctcagggcctttgccatctatacctccatctccagtgagttcaccccacacagccagccctgggtgctgctgcgtacatgcaaggagagggtgtcagagctcgggtaagagggggtgcagggacagaag

SEQ ID NO: 3271 - DNA, 170 bp, Homo sapiens
gctgtacgcctgggagaacatcttccgcacgcgggtggagacgacccgcaggaaggagatgaccagcctcagggcctttgccatctatacctccatctccagtgagttcaccccacacagccagccctgggtgctgctgcgtacatgcaaggagagggtgtcagagctcg

SEQ ID NO: 3272 - DNA, 170 bp, Homo sapiens
gagatgctccgcggcatcaagctgctgaagctgtacgcctgggagaacatcttccgcacgcgggtggagacgacccgcaggaaggagatgaccagcctcagggcctttgccatctatacctccatctccagtgagttcaccccacacagccagccctgggtgctgctgcg

SEQ ID NO: 3273 - DNA, 170 bp, Homo sapiens
tgagcggctgaagcagaccaacgagatgctccgcggcatcaagctgctgaagctgtacgcctgggagaacatcttccgcacgcgggtggagacgacccgcaggaaggagatgaccagcctcagggcctttgccatctatacctccatctccagtgagttcaccccacaca

SEQ ID NO: 3274 - DNA, 170 bp, Homo sapiens
gggacccctgcaggagtattccaatgagcggctgaagcagaccaacgagatgctccgcggcatcaagctgctgaagctgtacgcctgggagaacatcttccgcacgcgggtggagacgacccgcaggaaggagatgaccagcctcagggcctttgccatctatacctcca

SEQ ID NO: 3275 - DNA, 170 bp, Homo sapiens
agcagaagcctctcccctctgactcggggacccctgcaggagtattccaatgagcggctgaagcagaccaacgagatgctccgcggcatcaagctgctgaagctgtacgcctgggagaacatcttccgcacgcgggtggagacgacccgcaggaaggagatgaccagcct

SEQ ID NO: 3276 - DNA, 170 bp, Homo sapiens
caggccttcctctcgggtgggagacggagcagaagcctctcccctctgactcggggacccctgcaggagtattccaatgagcggctgaagcagaccaacgagatgctccgcggcatcaagctgctgaagctgtacgcctgggagaacatcttccgcacgcgggtggagac

SEQ ID NO: 3277 - DNA, 170 bp, Homo sapiens
ggcatggcagtgacagtattgacactcaggccttcctctcgggtgggagacggagcagaagcctctcccctctgactcggggacccctgcaggagtattccaatgagcggctgaagcagaccaacgagatgctccgcggcatcaagctgctgaagctgtacgcctgggag

SEQ ID NO: 3278 - DNA, 170 bp, Homo sapiens
ccattgcagctgtcctcatagtaagtggatcctttctccatctcttgggggtagggtggagggggagggcgtctgcagtgacaggctgcccagatttggcctttctgcacaggggcctcagaagacaggctccacagccagactgaaaataggatcgaaagtttatagag

SEQ ID NO: 3279 - DNA, 170 bp, Homo sapiens
ctgcagttttcatgaacacggccatccccattgcagctgtcctcatagtaagtggatcctttctccatctcttgggggtagggtggagggggagggcgtctgcagtgacaggctgcccagatttggcctttctgcacaggggcctcagaagacaggctccacagccagac

SEQ ID NO: 3280 - DNA, 170 bp, Homo sapiens
actaaacgcctccctgtgcttcctctgcagttttcatgaacacggccatccccattgcagctgtcctcatagtaagtggatcctttctccatctcttgggggtagggtggagggggagggcgtctgcagtgacaggctgcccagatttggcctttctgcacaggggcctc

SEQ ID NO: 3281 - DNA, 170 bp, Homo sapiens
ccatgtgtagctgtcacgctcctcccactaaacgcctccctgtgcttcctctgcagttttcatgaacacggccatccccattgcagctgtcctcatagtaagtggatcctttctccatctcttgggggtagggtggagggggagggcgtctgcagtgacaggctgcccag

SEQ ID NO: 3282 - DNA, 170 bp, Homo sapiens
cctccaagccatcctgggcatctccatgtgtagctgtcacgctcctcccactaaacgcctccctgtgcttcctctgcagttttcatgaacacggccatccccattgcagctgtcctcatagtaagtggatcctttctccatctcttgggggtagggtggagggggagggc

SEQ ID NO: 3283 - DNA, 170 bp, Homo sapiens
tggccccactggactgcgctgcctccaagccatcctgggcatctccatgtgtagctgtcacgctcctcccactaaacgcctccctgtgcttcctctgcagttttcatgaacacggccatccccattgcagctgtcctcatagtaagtggatcctttctccatctcttggg

SEQ ID NO: 3284 - DNA, 170 bp, Homo sapiens
ccctagcctactggagctgtgccccacaggctggccccactggactgcgctgcctccaagccatcctgggcatctccatgtgtagctgtcacgctcctcccactaaacgcctccctgtgcttcctctgcagttttcatgaacacggccatccccattgcagctgtcctca

SEQ ID NO: 3285 - DNA, 170 bp, Homo sapiens
accgtcaaagctctagtgaggtgaggggagggtccgggcgagggcactgggcaggcaggtcctgtgtcagcctcaaggcttgctcgagtgatggccaaaccacagctgtttggtcccggaacacacccccattgctgggccttgctgtagctggtcctggttggtcagag

SEQ ID NO: 3286 - DNA, 170 bp, Homo sapiens
ctgctgtccagtgtggtccgatctaccgtcaaagctctagtgaggtgaggggagggtccgggcgagggcactgggcaggcaggtcctgtgtcagcctcaaggcttgctcgagtgatggccaaaccacagctgtttggtcccggaacacacccccattgctgggccttgct

SEQ ID NO: 3287 - DNA, 170 bp, Homo sapiens
aagatcctcttaggagcctgctccctgacagccctctcatttcccttccagtgctgagcgtttccagtgtgggagggacccacaccctgggccaccctggcctcacttgtgcctctgtccacagactttcgtgggccacgtcagcttcttcaaagaggccgacttctcgc

SEQ ID NO: 3288 - DNA, 170 bp, Homo sapiens
cttccatatcttggtcacaccgctgttcctgctgtccagtgtggtccgatctaccgtcaaagctctagtgaggtgaggggagggtccgggcgagggcactgggcaggcaggtcctgtgtcagcctcaaggcttgctcgagtgatggccaaaccacagctgtttggtcccg

SEQ ID NO: 3289 - DNA, 170 bp, Homo sapiens
tggcctttgcctccctctccctcttccatatcttggtcacaccgctgttcctgctgtccagtgtggtccgatctaccgtcaaagctctagtgaggtgaggggagggtccgggcgagggcactgggcaggcaggtcctgtgtcagcctcaaggcttgctcgagtgatggcc

SEQ ID NO: 3290 - DNA, 170 bp, Homo sapiens
tcaaagaggccgacttctcgccctccgtggcctttgcctccctctccctcttccatatcttggtcacaccgctgttcctgctgtccagtgtggtccgatctaccgtcaaagctctagtgaggtgaggggagggtccgggcgagggcactgggcaggcaggtcctgtgtca

SEQ ID NO: 3291 - DNA, 170 bp, Homo sapiens
agactttcgtgggccacgtcagcttcttcaaagaggccgacttctcgccctccgtggcctttgcctccctctccctcttccatatcttggtcacaccgctgttcctgctgtccagtgtggtccgatctaccgtcaaagctctagtgaggtgaggggagggtccgggcgag

SEQ ID NO: 3292 - DNA, 170 bp, Homo sapiens
ctcacttgtgcctctgtccacagactttcgtgggccacgtcagcttcttcaaagaggccgacttctcgccctccgtggcctttgcctccctctccctcttccatatcttggtcacaccgctgttcctgctgtccagtgtggtccgatctaccgtcaaagctctagtgagg

SEQ ID NO: 3293 - DNA, 170 bp, Homo sapiens
cccacaccctgggccaccctggcctcacttgtgcctctgtccacagactttcgtgggccacgtcagcttcttcaaagaggccgacttctcgccctccgtggcctttgcctccctctccctcttccatatcttggtcacaccgctgttcctgctgtccagtgtggtccgat

SEQ ID NO: 3294 - DNA, 170 bp, Homo sapiens
tgctgagcgtttccagtgtgggagggacccacaccctgggccaccctggcctcacttgtgcctctgtccacagactttcgtgggccacgtcagcttcttcaaagaggccgacttctcgccctccgtggcctttgcctccctctccctcttccatatcttggtcacaccgc

SEQ ID NO: 3295 - DNA, 170 bp, Homo sapiens
cagccctctcatttcccttccagtgctgagcgtttccagtgtgggagggacccacaccctgggccaccctggcctcacttgtgcctctgtccacagactttcgtgggccacgtcagcttcttcaaagaggccgacttctcgccctccgtggcctttgcctccctctccct

SEQ ID NO: 3296 - DNA, 170 bp, Homo sapiens
cctcagggcccagccagcaagtaccaggcggtggtgagtgcccggcctccccttgctactcccagcatggtcctctaaggcccaaaacttgggcctgctgtgtcggacttctgccttttttcccaggaagaggggctcccttccctacacagctcccagcccagtgggtc

SEQ ID NO: 3297 - DNA, 170 bp, Homo sapiens
agcagtgtgccccccatgagcccacacctcagggcccagccagcaagtaccaggcggtggtgagtgcccggcctccccttgctactcccagcatggtcctctaaggcccaaaacttgggcctgctgtgtcggacttctgccttttttcccaggaagaggggctcccttcc

SEQ ID NO: 3298 - DNA, 170 bp, Homo sapiens
tcctgtccagtgcagagatccgtgaggagcagtgtgccccccatgagcccacacctcagggcccagccagcaagtaccaggcggtggtgagtgcccggcctccccttgctactcccagcatggtcctctaaggcccaaaacttgggcctgctgtgtcggacttctgcctt

SEQ ID NO: 3299 - DNA, 170 bp, Homo sapiens
gcagcgtgcaaaagctaagcgagttcctgtccagtgcagagatccgtgaggagcagtgtgccccccatgagcccacacctcagggcccagccagcaagtaccaggcggtggtgagtgcccggcctccccttgctactcccagcatggtcctctaaggcccaaaacttggg

SEQ ID NO: 3300 - DNA, 170 bp, Homo sapiens
gtgaggggtgtctctgtgcttcccgagcagcgtgcaaaagctaagcgagttcctgtccagtgcagagatccgtgaggagcagtgtgccccccatgagcccacacctcagggcccagccagcaagtaccaggcggtggtgagtgcccggcctccccttgctactcccagca

SEQ ID NO: 3301 - DNA, 170 bp, Homo sapiens
ccctcccctctgcccctggcaggggtgaggggtgtctctgtgcttcccgagcagcgtgcaaaagctaagcgagttcctgtccagtgcagagatccgtgaggagcagtgtgccccccatgagcccacacctcagggcccagccagcaagtaccaggcggtggtgagtgccc

SEQ ID NO: 3302 - DNA, 170 bp, Homo sapiens
gagctctctatcaggctgcgccctctcccctcccctctgcccctggcaggggtgaggggtgtctctgtgcttcccgagcagcgtgcaaaagctaagcgagttcctgtccagtgcagagatccgtgaggagcagtgtgccccccatgagcccacacctcagggcccagcca

SEQ ID NO: 3303 - DNA, 170 bp, Homo sapiens
atacttcaggcctgagatcctgctcagagctctctatcaggctgcgccctctcccctcccctctgcccctggcaggggtgaggggtgtctctgtgcttcccgagcagcgtgcaaaagctaagcgagttcctgtccagtgcagagatccgtgaggagcagtgtgcccccca

SEQ ID NO: 3304 - DNA, 170 bp, Homo sapiens
ttcagtgtgggctttgtgggactatacttcaggcctgagatcctgctcagagctctctatcaggctgcgccctctcccctcccctctgcccctggcaggggtgaggggtgtctctgtgcttcccgagcagcgtgcaaaagctaagcgagttcctgtccagtgcagagatc

SEQ ID NO: 3305 - DNA, 170 bp, Homo sapiens
agcctggtccccagtgcagatggcgatgctgacaactgctgtgtccaggtgagtcctgctgccccatgcctggccacccagcaccaactcccagagggagctcagcacctggaaagccagaaagctgcatgcttagtcctctgcagaggtcaccctgcctgcctgtacgg

SEQ ID NO: 3306 - DNA, 170 bp, Homo sapiens
caccggcccactgcagagcctggtccccagtgcagatggcgatgctgacaactgctgtgtccaggtgagtcctgctgccccatgcctggccacccagcaccaactcccagagggagctcagcacctggaaagccagaaagctgcatgcttagtcctctgcagaggtcacc

SEQ ID NO: 3307 - DNA, 170 bp, Homo sapiens
ccagcccgggaggattgtcggggcctcaccggcccactgcagagcctggtccccagtgcagatggcgatgctgacaactgctgtgtccaggtgagtcctgctgccccatgcctggccacccagcaccaactcccagagggagctcagcacctggaaagccagaaagctgc

SEQ ID NO: 3308 - DNA, 170 bp, Homo sapiens
cccctcagggttgtgaaccgcaagcgtccagcccgggaggattgtcggggcctcaccggcccactgcagagcctggtccccagtgcagatggcgatgctgacaactgctgtgtccaggtgagtcctgctgccccatgcctggccacccagcaccaactcccagagggagc

SEQ ID NO: 3309 - DNA, 170 bp, Homo sapiens
gggtcctcacctccaaaccacccccagcccctcagggttgtgaaccgcaagcgtccagcccgggaggattgtcggggcctcaccggcccactgcagagcctggtccccagtgcagatggcgatgctgacaactgctgtgtccaggtgagtcctgctgccccatgcctggc

SEQ ID NO: 3310 - DNA, 170 bp, Homo sapiens
cctacacagctcccagcccagtgggtcctcacctccaaaccacccccagcccctcagggttgtgaaccgcaagcgtccagcccgggaggattgtcggggcctcaccggcccactgcagagcctggtccccagtgcagatggcgatgctgacaactgctgtgtccaggtga

SEQ ID NO: 3311 - DNA, 170 bp, Homo sapiens
tttttcccaggaagaggggctcccttccctacacagctcccagcccagtgggtcctcacctccaaaccacccccagcccctcagggttgtgaaccgcaagcgtccagcccgggaggattgtcggggcctcaccggcccactgcagagcctggtccccagtgcagatggcg

SEQ ID NO: 3312 - DNA, 170 bp, Homo sapiens
ggcctgctgtgtcggacttctgccttttttcccaggaagaggggctcccttccctacacagctcccagcccagtgggtcctcacctccaaaccacccccagcccctcagggttgtgaaccgcaagcgtccagcccgggaggattgtcggggcctcaccggcccactgcag

SEQ ID NO: 3313 - DNA, 170 bp, Homo sapiens
gcatggtcctctaaggcccaaaacttgggcctgctgtgtcggacttctgccttttttcccaggaagaggggctcccttccctacacagctcccagcccagtgggtcctcacctccaaaccacccccagcccctcagggttgtgaaccgcaagcgtccagcccgggaggat

SEQ ID NO: 3314 - DNA, 170 bp, Homo sapiens
caccattcgtatcccccgaggtatggcccagtccacccctccagcatgcccctccccatgtcccactgaataacatagagataaaaagacaaagctgcatttattgagcacctactctctgctcattcttggtgtatgccctgggtatattatagaaggggaaggctaca

SEQ ID NO: 3315 - DNA, 170 bp, Homo sapiens
tggaatccccacactgtccaacatcaccattcgtatcccccgaggtatggcccagtccacccctccagcatgcccctccccatgtcccactgaataacatagagataaaaagacaaagctgcatttattgagcacctactctctgctcattcttggtgtatgccctgggt

SEQ ID NO: 3316 - DNA, 170 bp, Homo sapiens
aggctacttcacgtggaccccagatggaatccccacactgtccaacatcaccattcgtatcccccgaggtatggcccagtccacccctccagcatgcccctccccatgtcccactgaataacatagagataaaaagacaaagctgcatttattgagcacctactctctgc

SEQ ID NO: 3317 - DNA, 170 bp, Homo sapiens
gggacacgcctaatgaagatcatgggaggctacttcacgtggaccccagatggaatccccacactgtccaacatcaccattcgtatcccccgaggtatggcccagtccacccctccagcatgcccctccccatgtcccactgaataacatagagataaaaagacaaagct

SEQ ID NO: 3318 - DNA, 170 bp, Homo sapiens
gctgcctttctgttctctcctgggcggtgggacacgcctaatgaagatcatgggaggctacttcacgtggaccccagatggaatccccacactgtccaacatcaccattcgtatcccccgaggtatggcccagtccacccctccagcatgcccctccccatgtcccactg

SEQ ID NO: 3319 - DNA, 170 bp, Homo sapiens
agccagagactattcactgggaactggctgcctttctgttctctcctgggcggtgggacacgcctaatgaagatcatgggaggctacttcacgtggaccccagatggaatccccacactgtccaacatcaccattcgtatcccccgaggtatggcccagtccacccctcc

SEQ ID NO: 3320 - DNA, 170 bp, Homo sapiens
tggctttcatggaggaggggaagccagagactattcactgggaactggctgcctttctgttctctcctgggcggtgggacacgcctaatgaagatcatgggaggctacttcacgtggaccccagatggaatccccacactgtccaacatcaccattcgtatcccccgagg

SEQ ID NO: 3321 - DNA, 170 bp, Homo sapiens
tccaggggctggaatcagtgtcttttggctttcatggaggaggggaagccagagactattcactgggaactggctgcctttctgttctctcctgggcggtgggacacgcctaatgaagatcatgggaggctacttcacgtggaccccagatggaatccccacactgtcca

SEQ ID NO: 3322 - DNA, 170 bp, Homo sapiens
tcccactcccctgctctggaagtgatccaggggctggaatcagtgtcttttggctttcatggaggaggggaagccagagactattcactgggaactggctgcctttctgttctctcctgggcggtgggacacgcctaatgaagatcatgggaggctacttcacgtggacc

SEQ ID NO: 3323 - DNA, 170 bp, Homo sapiens
caggggctgtcttctggagcaggtaatacatgtatcctcagggcccagtggaggggaaatctccttttaaccatcctcctcagttgaggatgcacacacatttattggagggcccactctgtgttcagtgaggactcaataaatgctgctaatggatattctcatcatca

SEQ ID NO: 3324 - DNA, 170 bp, Homo sapiens
cactgggggagatgcagaaggtctcaggggctgtcttctggagcaggtaatacatgtatcctcagggcccagtggaggggaaatctccttttaaccatcctcctcagttgaggatgcacacacatttattggagggcccactctgtgttcagtgaggactcaataaatgc

SEQ ID NO: 3325 - DNA, 170 bp, Homo sapiens
cggcaagtcctcgctccttctagccgcactgggggagatgcagaaggtctcaggggctgtcttctggagcaggtaatacatgtatcctcagggcccagtggaggggaaatctccttttaaccatcctcctcagttgaggatgcacacacatttattggagggcccactct

SEQ ID NO: 3326 - DNA, 170 bp, Homo sapiens
actatgatcgtggggcaggtgggctgcggcaagtcctcgctccttctagccgcactgggggagatgcagaaggtctcaggggctgtcttctggagcaggtaatacatgtatcctcagggcccagtggaggggaaatctccttttaaccatcctcctcagttgaggatgca

SEQ ID NO: 3327 - DNA, 170 bp, Homo sapiens
cctccctccctgcaggccagctgactatgatcgtggggcaggtgggctgcggcaagtcctcgctccttctagccgcactgggggagatgcagaaggtctcaggggctgtcttctggagcaggtaatacatgtatcctcagggcccagtggaggggaaatctccttttaac

SEQ ID NO: 3328 - DNA, 170 bp, Homo sapiens
cccggccccactcacatctgccaccctccctccctgcaggccagctgactatgatcgtggggcaggtgggctgcggcaagtcctcgctccttctagccgcactgggggagatgcagaaggtctcaggggctgtcttctggagcaggtaatacatgtatcctcagggccca

SEQ ID NO: 3329 - DNA, 170 bp, Homo sapiens
tgtctttctgggtaatggttgttcagactcccccggccccactcacatctgccaccctccctccctgcaggccagctgactatgatcgtggggcaggtgggctgcggcaagtcctcgctccttctagccgcactgggggagatgcagaaggtctcaggggctgtcttctg

SEQ ID NO: 3330 - DNA, 170 bp, Homo sapiens
ccagggttgggtgcatctgtctgtctgtctttctgggtaatggttgttcagactcccccggccccactcacatctgccaccctccctccctgcaggccagctgactatgatcgtggggcaggtgggctgcggcaagtcctcgctccttctagccgcactgggggagatgc

SEQ ID NO: 3331 - DNA, 170 bp, Homo sapiens
aggtaggaagaaagaaaacaggggccccagggttgggtgcatctgtctgtctgtctttctgggtaatggttgttcagactcccccggccccactcacatctgccaccctccctccctgcaggccagctgactatgatcgtggggcaggtgggctgcggcaagtcctcgct

SEQ ID NO: 3332 - DNA, 170 bp, Homo sapiens
gagaggacttgctggggattctaggtaggaagaaagaaaacaggggccccagggttgggtgcatctgtctgtctgtctttctgggtaatggttgttcagactcccccggccccactcacatctgccaccctccctccctgcaggccagctgactatgatcgtggggcagg

SEQ ID NO: 3333 - DNA, 170 bp, Homo sapiens
gcgagataggagaggaccccaggtacagccttgggactgggtcagaagtgggtctcaacaaagggaaggggtagggtgggggtggaggacttgtgggtgggtaatgctgagtatggattcagggatgtgcagcctacatattttcagagacatggggctaaggcctgcat

SEQ ID NO: 3334 - DNA, 170 bp, Homo sapiens
tcccagcagccttcctgacagcgagataggagaggaccccaggtacagccttgggactgggtcagaagtgggtctcaacaaagggaaggggtagggtgggggtggaggacttgtgggtgggtaatgctgagtatggattcagggatgtgcagcctacatattttcagaga

SEQ ID NO: 3335 - DNA, 170 bp, Homo sapiens
actggtgttggtctgtcccatttgtgtcccagcagccttcctgacagcgagataggagaggaccccaggtacagccttgggactgggtcagaagtgggtctcaacaaagggaaggggtagggtgggggtggaggacttgtgggtgggtaatgctgagtatggattcaggg

SEQ ID NO: 3336 - DNA, 170 bp, Homo sapiens
tgatggaaaggcaatggggtgggaactaactggtgttggtctgtcccatttgtgtcccagcagccttcctgacagcgagataggagaggaccccaggtacagccttgggactgggtcagaagtgggtctcaacaaagggaaggggtagggtgggggtggaggacttgtgg

SEQ ID NO: 3337 - DNA, 170 bp, Homo sapiens
ttgcttctcccctaagactcagcgtgatggaaaggcaatggggtgggaactaactggtgttggtctgtcccatttgtgtcccagcagccttcctgacagcgagataggagaggaccccaggtacagccttgggactgggtcagaagtgggtctcaacaaagggaaggggt

SEQ ID NO: 3338 - DNA, 170 bp, Homo sapiens
gggtgggagggttggaggtggggattgcttctcccctaagactcagcgtgatggaaaggcaatggggtgggaactaactggtgttggtctgtcccatttgtgtcccagcagccttcctgacagcgagataggagaggaccccaggtacagccttgggactgggtcagaag

SEQ ID NO: 3339 - DNA, 170 bp, Homo sapiens
cagaggccatttggaaaccctgggaatgggtgggagggttggaggtggggattgcttctcccctaagactcagcgtgatggaaaggcaatggggtgggaactaactggtgttggtctgtcccatttgtgtcccagcagccttcctgacagcgagataggagaggacccca

SEQ ID NO: 3340 - DNA, 170 bp, Homo sapiens
cccagagcgggagacagcgaccgacttggatatcaggtactgcgtcctgggaacattgccccccagggtcaactccctccagggtgctctcaggcccaagggagccacatcaccctgctgggcagcccccagaccccagccccagtgttgggggaggccagggagggccc

SEQ ID NO: 3341 - DNA, 170 bp, Homo sapiens
agtatgcctttcctcccctgctgcagcccagagcgggagacagcgaccgacttggatatcaggtactgcgtcctgggaacattgccccccagggtcaactccctccagggtgctctcaggcccaagggagccacatcaccctgctgggcagcccccagaccccagcccca

SEQ ID NO: 3342 - DNA, 170 bp, Homo sapiens
atggttcactcccatgagagctcagtatgcctttcctcccctgctgcagcccagagcgggagacagcgaccgacttggatatcaggtactgcgtcctgggaacattgccccccagggtcaactccctccagggtgctctcaggcccaagggagccacatcaccctgctgg

SEQ ID NO: 3343 - DNA, 170 bp, Homo sapiens
agggagctcaggatcttcctggaggatatggttcactcccatgagagctcagtatgcctttcctcccctgctgcagcccagagcgggagacagcgaccgacttggatatcaggtactgcgtcctgggaacattgccccccagggtcaactccctccagggtgctctcagg

SEQ ID NO: 3344 - DNA, 170 bp, Homo sapiens
aaggcatgctcatgttgggttggagggagctcaggatcttcctggaggatatggttcactcccatgagagctcagtatgcctttcctcccctgctgcagcccagagcgggagacagcgaccgacttggatatcaggtactgcgtcctgggaacattgccccccagggtca

SEQ ID NO: 3345 - DNA, 170 bp, Homo sapiens
agactgggtccaggggattgtaaaggcatgctcatgttgggttggagggagctcaggatcttcctggaggatatggttcactcccatgagagctcagtatgcctttcctcccctgctgcagcccagagcgggagacagcgaccgacttggatatcaggtactgcgtcctg

SEQ ID NO: 3346 - DNA, 170 bp, Homo sapiens
tcatctttgagagtcccttcaacaaacaacggtaaaagcctgtcggagggaggcaggatgtggaggggaggaactgtctctggccagcctgccccagttccgggcccctccatcgatcacccacacccagccatctcactccccaggtgcttacctgcactccagcctct

SEQ ID NO: 3347 - DNA, 170 bp, Homo sapiens
aaatgccactgtggaggagaacatcatctttgagagtcccttcaacaaacaacggtaaaagcctgtcggagggaggcaggatgtggaggggaggaactgtctctggccagcctgccccagttccgggcccctccatcgatcacccacacccagccatctcactccccagg

SEQ ID NO: 3348 - DNA, 170 bp, Homo sapiens
cctatgcttcgcagaaaccatggctgctaaatgccactgtggaggagaacatcatctttgagagtcccttcaacaaacaacggtaaaagcctgtcggagggaggcaggatgtggaggggaggaactgtctctggccagcctgccccagttccgggcccctccatcgatca

SEQ ID NO: 3349 - DNA, 170 bp, Homo sapiens
ttttccaggaagagaggccccgtggcctatgcttcgcagaaaccatggctgctaaatgccactgtggaggagaacatcatctttgagagtcccttcaacaaacaacggtaaaagcctgtcggagggaggcaggatgtggaggggaggaactgtctctggccagcctgccc

SEQ ID NO: 3350 - DNA, 170 bp, Homo sapiens
ccccctactcccgccctgctttttccaggaagagaggccccgtggcctatgcttcgcagaaaccatggctgctaaatgccactgtggaggagaacatcatctttgagagtcccttcaacaaacaacggtaaaagcctgtcggagggaggcaggatgtggaggggaggaac

SEQ ID NO: 3351 - DNA, 170 bp, Homo sapiens
acaagcccctgagaatgccttccgcaccccctactcccgccctgctttttccaggaagagaggccccgtggcctatgcttcgcagaaaccatggctgctaaatgccactgtggaggagaacatcatctttgagagtcccttcaacaaacaacggtaaaagcctgtcggag

SEQ ID NO: 3352 - DNA, 170 bp, Homo sapiens
tcagcttgacaactgcctctgagaacaagcccctgagaatgccttccgcaccccctactcccgccctgctttttccaggaagagaggccccgtggcctatgcttcgcagaaaccatggctgctaaatgccactgtggaggagaacatcatctttgagagtcccttcaaca

SEQ ID NO: 3353 - DNA, 170 bp, Homo sapiens
cccatccccttgcctccatctgagccatcagcttgacaactgcctctgagaacaagcccctgagaatgccttccgcaccccctactcccgccctgctttttccaggaagagaggccccgtggcctatgcttcgcagaaaccatggctgctaaatgccactgtggaggaga

SEQ ID NO: 3354 - DNA, 170 bp, Homo sapiens
agcagatttctaccaactgcacctccccatccccttgcctccatctgagccatcagcttgacaactgcctctgagaacaagcccctgagaatgccttccgcaccccctactcccgccctgctttttccaggaagagaggccccgtggcctatgcttcgcagaaaccatgg

SEQ ID NO: 3355 - DNA, 170 bp, Homo sapiens
tgagattgcagagggcatcctgtctgatgggtgagtgactgtctgaggactcaggaaagtgaatctgctccagggtacttcctgaaaggcccaaggagatcctagctcacctatattccacaagcccatgtcttttgttactacatccagcagctcagtgtcttctatgt

SEQ ID NO: 3356 - DNA, 170 bp, Homo sapiens
tcatgctgctcttcgtcctggtgtgtgagattgcagagggcatcctgtctgatgggtgagtgactgtctgaggactcaggaaagtgaatctgctccagggtacttcctgaaaggcccaaggagatcctagctcacctatattccacaagcccatgtcttttgttactaca

SEQ ID NO: 3357 - DNA, 170 bp, Homo sapiens
gtgtaccagccttggggatcctcatgtgtaggtgtcaccctcaccatggacccaatgcccaagcacctttctggggttcatgcaccctcttcctcctccaagtgggcaggcatcctgcctctgactgtctctccctgcaggatggggaagtcagagctccaaggtgcaca

SEQ ID NO: 3358 - DNA, 170 bp, Homo sapiens
acaacctgcggtggatcctgaccttcatgctgctcttcgtcctggtgtgtgagattgcagagggcatcctgtctgatgggtgagtgactgtctgaggactcaggaaagtgaatctgctccagggtacttcctgaaaggcccaaggagatcctagctcacctatattccac

SEQ ID NO: 3359 - DNA, 170 bp, Homo sapiens
cacagcacatggcttcatttccctgggcacaacctgcggtggatcctgaccttcatgctgctcttcgtcctggtgtgtgagattgcagagggcatcctgtctgatgggtgagtgactgtctgaggactcaggaaagtgaatctgctccagggtacttcctgaaaggccca

SEQ ID NO: 3360 - DNA, 170 bp, Homo sapiens
gagctccaaggtgcacatccaccacagcacatggcttcatttccctgggcacaacctgcggtggatcctgaccttcatgctgctcttcgtcctggtgtgtgagattgcagagggcatcctgtctgatgggtgagtgactgtctgaggactcaggaaagtgaatctgctcc

SEQ ID NO: 3361 - DNA, 170 bp, Homo sapiens
tctctccctgcaggatggggaagtcagagctccaaggtgcacatccaccacagcacatggcttcatttccctgggcacaacctgcggtggatcctgaccttcatgctgctcttcgtcctggtgtgtgagattgcagagggcatcctgtctgatgggtgagtgactgtctg

SEQ ID NO: 3362 - DNA, 170 bp, Homo sapiens
gggcaggcatcctgcctctgactgtctctccctgcaggatggggaagtcagagctccaaggtgcacatccaccacagcacatggcttcatttccctgggcacaacctgcggtggatcctgaccttcatgctgctcttcgtcctggtgtgtgagattgcagagggcatcct

SEQ ID NO: 3363 - DNA, 170 bp, Homo sapiens
tcatgcaccctcttcctcctccaagtgggcaggcatcctgcctctgactgtctctccctgcaggatggggaagtcagagctccaaggtgcacatccaccacagcacatggcttcatttccctgggcacaacctgcggtggatcctgaccttcatgctgctcttcgtcctg

SEQ ID NO: 3364 - DNA, 170 bp, Homo sapiens
cccaatgcccaagcacctttctggggttcatgcaccctcttcctcctccaagtgggcaggcatcctgcctctgactgtctctccctgcaggatggggaagtcagagctccaaggtgcacatccaccacagcacatggcttcatttccctgggcacaacctgcggtggatc

SEQ ID NO: 3365 - DNA, 170 bp, Homo sapiens
gtaggtgtcaccctcaccatggacccaatgcccaagcacctttctggggttcatgcaccctcttcctcctccaagtgggcaggcatcctgcctctgactgtctctccctgcaggatggggaagtcagagctccaaggtgcacatccaccacagcacatggcttcatttcc

SEQ ID NO: 3366 - DNA, 170 bp, Homo sapiens
agaccagacccagattggggaacgggttagtagcagcctctgaggggttttttcaaagccaggacccccaacctaccatgccctgagacactactcaggacaatgggtaactaggaaataggagacattgaaggctgaagagttgcctgcagtaaggtcaaacatgttgt

SEQ ID NO: 3367 - DNA, 170 bp, Homo sapiens
atcgacatcctgccccatggagaccagacccagattggggaacgggttagtagcagcctctgaggggttttttcaaagccaggacccccaacctaccatgccctgagacactactcaggacaatgggtaactaggaaataggagacattgaaggctgaagagttgcctgc

SEQ ID NO: 3368 - DNA, 170 bp, Homo sapiens
tgaagcctgctctctgcagccagacatcgacatcctgccccatggagaccagacccagattggggaacgggttagtagcagcctctgaggggttttttcaaagccaggacccccaacctaccatgccctgagacactactcaggacaatgggtaactaggaaataggaga

SEQ ID NO: 3369 - DNA, 170 bp, Homo sapiens
acccacgccaggtacaagatggtcattgaagcctgctctctgcagccagacatcgacatcctgccccatggagaccagacccagattggggaacgggttagtagcagcctctgaggggttttttcaaagccaggacccccaacctaccatgccctgagacactactcagg

SEQ ID NO: 3370 - DNA, 170 bp, Homo sapiens
gctgaccagctgcatcccctgcctctacccacgccaggtacaagatggtcattgaagcctgctctctgcagccagacatcgacatcctgccccatggagaccagacccagattggggaacgggttagtagcagcctctgaggggttttttcaaagccaggacccccaacc

SEQ ID NO: 3371 - DNA, 170 bp, Homo sapiens
agtgctcgggccaactctgaccaggctgaccagctgcatcccctgcctctacccacgccaggtacaagatggtcattgaagcctgctctctgcagccagacatcgacatcctgccccatggagaccagacccagattggggaacgggttagtagcagcctctgaggggtt

SEQ ID NO: 3372 - DNA, 170 bp, Homo sapiens
gctacccagagactaatgaccctctgcaagtgctcgggccaactctgaccaggctgaccagctgcatcccctgcctctacccacgccaggtacaagatggtcattgaagcctgctctctgcagccagacatcgacatcctgccccatggagaccagacccagattgggga

SEQ ID NO: 3373 - DNA, 170 bp, Homo sapiens
gccattgctcaccctgggcatagctacccagagactaatgaccctctgcaagtgctcgggccaactctgaccaggctgaccagctgcatcccctgcctctacccacgccaggtacaagatggtcattgaagcctgctctctgcagccagacatcgacatcctgccccatg

SEQ ID NO: 3374 - DNA, 170 bp, Homo sapiens
acccaagcgggaggcctattaaagccattgctcaccctgggcatagctacccagagactaatgaccctctgcaagtgctcgggccaactctgaccaggctgaccagctgcatcccctgcctctacccacgccaggtacaagatggtcattgaagcctgctctctgcagcc

SEQ ID NO: 3375 - DNA, 170 bp, Homo sapiens
acgccaacgttgtcttcttggtgagtgcaagttcccttggggtcctggtctctggctgcctcccaggcctaactgcccacctccacctccccgcaaccccaccatcatccaacaatctccctctccaggagtaaatccctcctgccagagatattgccttatcatcctag

SEQ ID NO: 3376 - DNA, 170 bp, Homo sapiens
gtggcccgagccctctaccagcacgccaacgttgtcttcttggtgagtgcaagttcccttggggtcctggtctctggctgcctcccaggcctaactgcccacctccacctccccgcaaccccaccatcatccaacaatctccctctccaggagtaaatccctcctgccag

SEQ ID NO: 3377 - DNA, 170 bp, Homo sapiens
ctggtggtcaacgccagcgaatcagtgtggcccgagccctctaccagcacgccaacgttgtcttcttggtgagtgcaagttcccttggggtcctggtctctggctgcctcccaggcctaactgcccacctccacctccccgcaaccccaccatcatccaacaatctccct

SEQ ID NO: 3378 - DNA, 170 bp, Homo sapiens
ctcctctttggtgacagggcatcaacctgtctggtggtcaacgccagcgaatcagtgtggcccgagccctctaccagcacgccaacgttgtcttcttggtgagtgcaagttcccttggggtcctggtctctggctgcctcccaggcctaactgcccacctccacctcccc

SEQ ID NO: 3379 - DNA, 170 bp, Homo sapiens
aatggctgagggcatgatgtgttcctcctctttggtgacagggcatcaacctgtctggtggtcaacgccagcgaatcagtgtggcccgagccctctaccagcacgccaacgttgtcttcttggtgagtgcaagttcccttggggtcctggtctctggctgcctcccaggc

SEQ ID NO: 3380 - DNA, 170 bp, Homo sapiens
cagtagggtacaggacagtgtctcctgaatggctgagggcatgatgtgttcctcctctttggtgacagggcatcaacctgtctggtggtcaacgccagcgaatcagtgtggcccgagccctctaccagcacgccaacgttgtcttcttggtgagtgcaagttcccttggg

SEQ ID NO: 3381 - DNA, 170 bp, Homo sapiens
tccatcccaaagagctcatagtccagtagggtacaggacagtgtctcctgaatggctgagggcatgatgtgttcctcctctttggtgacagggcatcaacctgtctggtggtcaacgccagcgaatcagtgtggcccgagccctctaccagcacgccaacgttgtcttct

SEQ ID NO: 3382 - DNA, 170 bp, Homo sapiens
ggcaaagaagtggatagagccaggcctccatcccaaagagctcatagtccagtagggtacaggacagtgtctcctgaatggctgagggcatgatgtgttcctcctctttggtgacagggcatcaacctgtctggtggtcaacgccagcgaatcagtgtggcccgagccct

SEQ ID NO: 3383 - DNA, 170 bp, Homo sapiens
ccttctctatgcaaggtgagaagcaggcaaagaagtggatagagccaggcctccatcccaaagagctcatagtccagtagggtacaggacagtgtctcctgaatggctgagggcatgatgtgttcctcctctttggtgacagggcatcaacctgtctggtggtcaacgcc

SEQ ID NO: 3384 - DNA, 170 bp, Homo sapiens
acctgccccatgcagactgggtgagggggaacaagggggtcaggctatagggggcagggctggggaggctgtcaggcatcttggcaggaaccaatccgttgtcttggtagcaactgctgagggccacaaagcataagagaccagcactggatggctttatgcatgctggg

SEQ ID NO: 3385 - DNA, 170 bp, Homo sapiens
tcttagtgacccacaagctacagtacctgccccatgcagactgggtgagggggaacaagggggtcaggctatagggggcagggctggggaggctgtcaggcatcttggcaggaaccaatccgttgtcttggtagcaactgctgagggccacaaagcataagagaccagca

SEQ ID NO: 3386 - DNA, 170 bp, Homo sapiens
gccacacagctaactagcttcagtccctagagcagagttgatagaactctaatgggttttatactcattgtcacccctccccaccatgcctttccctaccctctactctcttcctctcccttctgcccaggatgaccccttctcagctctggatatccatctgagtgacc

SEQ ID NO: 3387 - DNA, 170 bp, Homo sapiens
tccgggacgacaagaggacagtggtcttagtgacccacaagctacagtacctgccccatgcagactgggtgagggggaacaagggggtcaggctatagggggcagggctggggaggctgtcaggcatcttggcaggaaccaatccgttgtcttggtagcaactgctgagg

SEQ ID NO: 3388 - DNA, 170 bp, Homo sapiens
tgcaggccggcatccttgagctgctccgggacgacaagaggacagtggtcttagtgacccacaagctacagtacctgccccatgcagactgggtgagggggaacaagggggtcaggctatagggggcagggctggggaggctgtcaggcatcttggcaggaaccaatccg

SEQ ID NO: 3389 - DNA, 170 bp, Homo sapiens
cagctctggatatccatctgagtgaccacttaatgcaggccggcatccttgagctgctccgggacgacaagaggacagtggtcttagtgacccacaagctacagtacctgccccatgcagactgggtgagggggaacaagggggtcaggctatagggggcagggctgggg

SEQ ID NO: 3390 - DNA, 170 bp, Homo sapiens
ctgcccaggatgaccccttctcagctctggatatccatctgagtgaccacttaatgcaggccggcatccttgagctgctccgggacgacaagaggacagtggtcttagtgacccacaagctacagtacctgccccatgcagactgggtgagggggaacaagggggtcagg

SEQ ID NO: 3391 - DNA, 170 bp, Homo sapiens
accctctactctcttcctctcccttctgcccaggatgaccccttctcagctctggatatccatctgagtgaccacttaatgcaggccggcatccttgagctgctccgggacgacaagaggacagtggtcttagtgacccacaagctacagtacctgccccatgcagactg

SEQ ID NO: 3392 - DNA, 170 bp, Homo sapiens
cctccccaccatgcctttccctaccctctactctcttcctctcccttctgcccaggatgaccccttctcagctctggatatccatctgagtgaccacttaatgcaggccggcatccttgagctgctccgggacgacaagaggacagtggtcttagtgacccacaagctac

SEQ ID NO: 3393 - DNA, 170 bp, Homo sapiens
agaactctaatgggttttatactcattgtcacccctccccaccatgcctttccctaccctctactctcttcctctcccttctgcccaggatgaccccttctcagctctggatatccatctgagtgaccacttaatgcaggccggcatccttgagctgctccgggacgaca

SEQ ID NO: 3394 - DNA, 170 bp, Homo sapiens
agtccctagagcagagttgatagaactctaatgggttttatactcattgtcacccctccccaccatgcctttccctaccctctactctcttcctctcccttctgcccaggatgaccccttctcagctctggatatccatctgagtgaccacttaatgcaggccggcatcc

SEQ ID NO: 3395 - DNA, 170 bp, Homo sapiens
cgacaggaccaagagctggagaaggtgggtatatccagggatggccaagcagccacccctggatgcaaaggttctgctagaacctgaactcataaaggtcttcctgtccttagtgccccaggaagccccctaaagggcagatgtgggagctgggcatgaactggctccta

SEQ ID NO: 3396 - DNA, 170 bp, Homo sapiens
tgagcactggaagaccctcatgaaccgacaggaccaagagctggagaaggtgggtatatccagggatggccaagcagccacccctggatgcaaaggttctgctagaacctgaactcataaaggtcttcctgtccttagtgccccaggaagccccctaaagggcagatgtg

SEQ ID NO: 3397 - DNA, 170 bp, Homo sapiens
cagcccacttgcagtggatgagctggtggccatttgtagtgaggaaagggatgtgtcaacctccatcttagactccacaattgagggatgtgaccaccattcctccccagccagcccccaaaccacgtttgttgctgcctttccagatcattgccatgaaggatggcacc

SEQ ID NO: 3398 - DNA, 170 bp, Homo sapiens
tccagaggtctgaatgccagctctttgagcactggaagaccctcatgaaccgacaggaccaagagctggagaaggtgggtatatccagggatggccaagcagccacccctggatgcaaaggttctgctagaacctgaactcataaaggtcttcctgtccttagtgcccca

SEQ ID NO: 3399 - DNA, 170 bp, Homo sapiens
ccatccagagggagggtaccctcaaggacttccagaggtctgaatgccagctctttgagcactggaagaccctcatgaaccgacaggaccaagagctggagaaggtgggtatatccagggatggccaagcagccacccctggatgcaaaggttctgctagaacctgaact

SEQ ID NO: 3400 - DNA, 170 bp, Homo sapiens
tcattgccatgaaggatggcaccatccagagggagggtaccctcaaggacttccagaggtctgaatgccagctctttgagcactggaagaccctcatgaaccgacaggaccaagagctggagaaggtgggtatatccagggatggccaagcagccacccctggatgcaaa

SEQ ID NO: 3401 - DNA, 170 bp, Homo sapiens
tttgttgctgcctttccagatcattgccatgaaggatggcaccatccagagggagggtaccctcaaggacttccagaggtctgaatgccagctctttgagcactggaagaccctcatgaaccgacaggaccaagagctggagaaggtgggtatatccagggatggccaag

SEQ ID NO: 3402 - DNA, 170 bp, Homo sapiens
ctccccagccagcccccaaaccacgtttgttgctgcctttccagatcattgccatgaaggatggcaccatccagagggagggtaccctcaaggacttccagaggtctgaatgccagctctttgagcactggaagaccctcatgaaccgacaggaccaagagctggagaag

SEQ ID NO: 3403 - DNA, 170 bp, Homo sapiens
tccacaattgagggatgtgaccaccattcctccccagccagcccccaaaccacgtttgttgctgcctttccagatcattgccatgaaggatggcaccatccagagggagggtaccctcaaggacttccagaggtctgaatgccagctctttgagcactggaagaccctca

SEQ ID NO: 3404 - DNA, 170 bp, Homo sapiens
gggatgtgtcaacctccatcttagactccacaattgagggatgtgaccaccattcctccccagccagcccccaaaccacgtttgttgctgcctttccagatcattgccatgaaggatggcaccatccagagggagggtaccctcaaggacttccagaggtctgaatgcca

SEQ ID NO: 3405 - DNA, 170 bp, Homo sapiens
ctggtggccatttgtagtgaggaaagggatgtgtcaacctccatcttagactccacaattgagggatgtgaccaccattcctccccagccagcccccaaaccacgtttgttgctgcctttccagatcattgccatgaaggatggcaccatccagagggagggtaccctca

SEQ ID NO: 3406 - DNA, 170 bp, Homo sapiens
ctgcaggatgaggaagaggaggaaggtacaggcaatgggactgggagtgaaattatggcctgaggtctgatcagccacagagaggctaaggtttggggttctgggtgtggtgcagtagtgtgcctttgattaaatggcttccctctgtgtgcccccgttgtcccctcagt

SEQ ID NO: 3407 - DNA, 170 bp, Homo sapiens
tgtcctcgagggatggccttctgcaggatgaggaagaggaggaaggtacaggcaatgggactgggagtgaaattatggcctgaggtctgatcagccacagagaggctaaggtttggggttctgggtgtggtgcagtagtgtgcctttgattaaatggcttccctctgtgt

SEQ ID NO: 3408 - DNA, 170 bp, Homo sapiens
agccaccccagggcctatctcgtgccatgtcctcgagggatggccttctgcaggatgaggaagaggaggaaggtacaggcaatgggactgggagtgaaattatggcctgaggtctgatcagccacagagaggctaaggtttggggttctgggtgtggtgcagtagtgtgc

SEQ ID NO: 3409 - DNA, 170 bp, Homo sapiens
gactgtcacagagagaaaagccacagagccaccccagggcctatctcgtgccatgtcctcgagggatggccttctgcaggatgaggaagaggaggaaggtacaggcaatgggactgggagtgaaattatggcctgaggtctgatcagccacagagaggctaaggtttggg

SEQ ID NO: 3410 - DNA, 170 bp, Homo sapiens
ccaggccacatctgtcttttaggagactgtcacagagagaaaagccacagagccaccccagggcctatctcgtgccatgtcctcgagggatggccttctgcaggatgaggaagaggaggaaggtacaggcaatgggactgggagtgaaattatggcctgaggtctgatca

SEQ ID NO: 3411 - DNA, 170 bp, Homo sapiens
caccaaccatatatcctgaagacattgcccaggccacatctgtcttttaggagactgtcacagagagaaaagccacagagccaccccagggcctatctcgtgccatgtcctcgagggatggccttctgcaggatgaggaagaggaggaaggtacaggcaatgggactggg

SEQ ID NO: 3412 - DNA, 170 bp, Homo sapiens
accccttaacttccccttcccccaccaaccatatatcctgaagacattgcccaggccacatctgtcttttaggagactgtcacagagagaaaagccacagagccaccccagggcctatctcgtgccatgtcctcgagggatggccttctgcaggatgaggaagaggagga

SEQ ID NO: 3413 - DNA, 170 bp, Homo sapiens
ctgacattggtcatcaccagagtagttaccccttaacttccccttcccccaccaaccatatatcctgaagacattgcccaggccacatctgtcttttaggagactgtcacagagagaaaagccacagagccaccccagggcctatctcgtgccatgtcctcgagggatgg

SEQ ID NO: 3414 - DNA, 170 bp, Homo sapiens
ccctcaggcagggacaaagtagaaatctgacattggtcatcaccagagtagttaccccttaacttccccttcccccaccaaccatatatcctgaagacattgcccaggccacatctgtcttttaggagactgtcacagagagaaaagccacagagccaccccagggccta

SEQ ID NO: 3415 - DNA, 170 bp, Homo sapiens
ctgaccctgacccctgcagccaggaactgctccctcagccaggtgtgactggcggcccatggcagaggttgggagtggggatgggggaagggctgagcccatgggcaccctggaactccaaatcactctctgcctgtgaaggagtgcaccctcgaccagactgtctatgc

SEQ ID NO: 3416 - DNA, 170 bp, Homo sapiens
gctggccaagtggaccgacagcgccctgaccctgacccctgcagccaggaactgctccctcagccaggtgtgactggcggcccatggcagaggttgggagtggggatgggggaagggctgagcccatgggcaccctggaactccaaatcactctctgcctgtgaaggagt

SEQ ID NO: 3417 - DNA, 170 bp, Homo sapiens
tcaccctcagagggatggaaatgtgtagccacagagtgggttcttgcggcctgcagaggaggcagctgagagcgaggaggatgacaacctgtcgtccatgctgcaccagcgtgctgagatcccatggcgagcctgcgccaagtacctgtcctccgccggcatcctgctcc

SEQ ID NO: 3418 - DNA, 170 bp, Homo sapiens
aagtggggataaaatgccctgattcaccctcagagggatggaaatgtgtagccacagagtgggttcttgcggcctgcagaggaggcagctgagagcgaggaggatgacaacctgtcgtccatgctgcaccagcgtgctgagatcccatggcgagcctgcgccaagtacct

SEQ ID NO: 3419 - DNA, 170 bp, Homo sapiens
tgcccccgttgtcccctcagtaagtggggataaaatgccctgattcaccctcagagggatggaaatgtgtagccacagagtgggttcttgcggcctgcagaggaggcagctgagagcgaggaggatgacaacctgtcgtccatgctgcaccagcgtgctgagatcccatg

SEQ ID NO: 3420 - DNA, 170 bp, Homo sapiens
agtgtgcctttgattaaatggcttccctctgtgtgcccccgttgtcccctcagtaagtggggataaaatgccctgattcaccctcagagggatggaaatgtgtagccacagagtgggttcttgcggcctgcagaggaggcagctgagagcgaggaggatgacaacctgtc

SEQ ID NO: 3421 - DNA, 170 bp, Homo sapiens
acatggtcctggtggccatcgactactggctggccaagtggaccgacagcgccctgaccctgacccctgcagccaggaactgctccctcagccaggtgtgactggcggcccatggcagaggttgggagtggggatgggggaagggctgagcccatgggcaccctggaact

SEQ ID NO: 3422 - DNA, 170 bp, Homo sapiens
tggtcttctcacagctgctcaagcacatggtcctggtggccatcgactactggctggccaagtggaccgacagcgccctgaccctgacccctgcagccaggaactgctccctcagccaggtgtgactggcggcccatggcagaggttgggagtggggatgggggaagggc

SEQ ID NO: 3423 - DNA, 170 bp, Homo sapiens
gccggcatcctgctcctgtcgttgctggtcttctcacagctgctcaagcacatggtcctggtggccatcgactactggctggccaagtggaccgacagcgccctgaccctgacccctgcagccaggaactgctccctcagccaggtgtgactggcggcccatggcagagg

SEQ ID NO: 3424 - DNA, 170 bp, Homo sapiens
agcctgcgccaagtacctgtcctccgccggcatcctgctcctgtcgttgctggtcttctcacagctgctcaagcacatggtcctggtggccatcgactactggctggccaagtggaccgacagcgccctgaccctgacccctgcagccaggaactgctccctcagccagg

SEQ ID NO: 3425 - DNA, 170 bp, Homo sapiens
caccagcgtgctgagatcccatggcgagcctgcgccaagtacctgtcctccgccggcatcctgctcctgtcgttgctggtcttctcacagctgctcaagcacatggtcctggtggccatcgactactggctggccaagtggaccgacagcgccctgaccctgacccctgc

SEQ ID NO: 3426 - DNA, 170 bp, Homo sapiens
aggatgacaacctgtcgtccatgctgcaccagcgtgctgagatcccatggcgagcctgcgccaagtacctgtcctccgccggcatcctgctcctgtcgttgctggtcttctcacagctgctcaagcacatggtcctggtggccatcgactactggctggccaagtggacc

SEQ ID NO: 3427 - DNA, 170 bp, Homo sapiens
agaggaggcagctgagagcgaggaggatgacaacctgtcgtccatgctgcaccagcgtgctgagatcccatggcgagcctgcgccaagtacctgtcctccgccggcatcctgctcctgtcgttgctggtcttctcacagctgctcaagcacatggtcctggtggccatcg

SEQ ID NO: 3428 - DNA, 170 bp, Homo sapiens
acagagtgggttcttgcggcctgcagaggaggcagctgagagcgaggaggatgacaacctgtcgtccatgctgcaccagcgtgctgagatcccatggcgagcctgcgccaagtacctgtcctccgccggcatcctgctcctgtcgttgctggtcttctcacagctgctca

SEQ ID NO: 3429 - DNA, 170 bp, Homo sapiens
gctaaaccggatcatcctagcccccatgaggtacccgtctcccctggccaggctgggactgtgagcaagtcactgttctctgagccttagtcttcccatctataaaatggggatatacaacctgtcacaagcttgtgggggtgactcaaggagacagtgtgtgtaaaagt

SEQ ID NO: 3430 - DNA, 170 bp, Homo sapiens
gtggccaagagactgcaccgcagcctgctaaaccggatcatcctagcccccatgaggtacccgtctcccctggccaggctgggactgtgagcaagtcactgttctctgagccttagtcttcccatctataaaatggggatatacaacctgtcacaagcttgtgggggtga

SEQ ID NO: 3431 - DNA, 170 bp, Homo sapiens
gctccctcagccaggtgtgactggcggcccatggcagaggttgggagtggggatgggggaagggctgagcccatgggcaccctggaactccaaatcactctctgcctgtgaaggagtgcaccctcgaccagactgtctatgccatggtgttcacggtgctctgcagcctg

SEQ ID NO: 3432 - DNA, 170 bp, Homo sapiens
cctgacccctgcagccaggaactgctccctcagccaggtgtgactggcggcccatggcagaggttgggagtggggatgggggaagggctgagcccatgggcaccctggaactccaaatcactctctgcctgtgaaggagtgcaccctcgaccagactgtctatgccatgg

SEQ ID NO: 3433 - DNA, 170 bp, Homo sapiens
tgtggagtggacagggctgaaggtggccaagagactgcaccgcagcctgctaaaccggatcatcctagcccccatgaggtacccgtctcccctggccaggctgggactgtgagcaagtcactgttctctgagccttagtcttcccatctataaaatggggatatacaacc

SEQ ID NO: 3434 - DNA, 170 bp, Homo sapiens
tgctgtgcctcgtcacgtctgtcactgtggagtggacagggctgaaggtggccaagagactgcaccgcagcctgctaaaccggatcatcctagcccccatgaggtacccgtctcccctggccaggctgggactgtgagcaagtcactgttctctgagccttagtcttccc

SEQ ID NO: 3435 - DNA, 170 bp, Homo sapiens
cacggtgctctgcagcctgggcattgtgctgtgcctcgtcacgtctgtcactgtggagtggacagggctgaaggtggccaagagactgcaccgcagcctgctaaaccggatcatcctagcccccatgaggtacccgtctcccctggccaggctgggactgtgagcaagtc

SEQ ID NO: 3436 - DNA, 170 bp, Homo sapiens
tcgaccagactgtctatgccatggtgttcacggtgctctgcagcctgggcattgtgctgtgcctcgtcacgtctgtcactgtggagtggacagggctgaaggtggccaagagactgcaccgcagcctgctaaaccggatcatcctagcccccatgaggtacccgtctccc

SEQ ID NO: 3437 - DNA, 170 bp, Homo sapiens
tctctgcctgtgaaggagtgcaccctcgaccagactgtctatgccatggtgttcacggtgctctgcagcctgggcattgtgctgtgcctcgtcacgtctgtcactgtggagtggacagggctgaaggtggccaagagactgcaccgcagcctgctaaaccggatcatcct

SEQ ID NO: 3438 - DNA, 170 bp, Homo sapiens
gggcaccctggaactccaaatcactctctgcctgtgaaggagtgcaccctcgaccagactgtctatgccatggtgttcacggtgctctgcagcctgggcattgtgctgtgcctcgtcacgtctgtcactgtggagtggacagggctgaaggtggccaagagactgcaccg

SEQ ID NO: 3439 - DNA, 170 bp, Homo sapiens
ggatgggggaagggctgagcccatgggcaccctggaactccaaatcactctctgcctgtgaaggagtgcaccctcgaccagactgtctatgccatggtgttcacggtgctctgcagcctgggcattgtgctgtgcctcgtcacgtctgtcactgtggagtggacagggct

SEQ ID NO: 3440 - DNA, 170 bp, Homo sapiens
ggcccatggcagaggttgggagtggggatgggggaagggctgagcccatgggcaccctggaactccaaatcactctctgcctgtgaaggagtgcaccctcgaccagactgtctatgccatggtgttcacggtgctctgcagcctgggcattgtgctgtgcctcgtcacgt

SEQ ID NO: 3441 - DNA, 170 bp, Homo sapiens
actgtaacaccatcgaccaggtacagaggaccgtgccacactatccccccttccagagacacctcggacccctgggggcttctcctgtctgaggctgggttccccagatcaggtgatcacagccctctgggaagaagccagtgtccccgatccgattataatgctgcttc

SEQ ID NO: 3442 - DNA, 170 bp, Homo sapiens
ggagcatcctgaacagattttcatctgactgtaacaccatcgaccaggtacagaggaccgtgccacactatccccccttccagagacacctcggacccctgggggcttctcctgtctgaggctgggttccccagatcaggtgatcacagccctctgggaagaagccagtg

SEQ ID NO: 3443 - DNA, 170 bp, Homo sapiens
ttttttgagaccacgccccttgggagcatcctgaacagattttcatctgactgtaacaccatcgaccaggtacagaggaccgtgccacactatccccccttccagagacacctcggacccctgggggcttctcctgtctgaggctgggttccccagatcaggtgatcaca

SEQ ID NO: 3444 - DNA, 170 bp, Homo sapiens
aactcttcctctggctgcctcttaggttttttgagaccacgccccttgggagcatcctgaacagattttcatctgactgtaacaccatcgaccaggtacagaggaccgtgccacactatccccccttccagagacacctcggacccctgggggcttctcctgtctgaggc

SEQ ID NO: 3445 - DNA, 170 bp, Homo sapiens
caggaagtaaatcaatggacaaatgagtaactcttcctctggctgcctcttaggttttttgagaccacgccccttgggagcatcctgaacagattttcatctgactgtaacaccatcgaccaggtacagaggaccgtgccacactatccccccttccagagacacctcgg

SEQ ID NO: 3446 - DNA, 170 bp, Homo sapiens
aaataattaactatctcattcagtaaacaggaagtaaatcaatggacaaatgagtaactcttcctctggctgcctcttaggttttttgagaccacgccccttgggagcatcctgaacagattttcatctgactgtaacaccatcgaccaggtacagaggaccgtgccaca

SEQ ID NO: 3447 - DNA, 170 bp, Homo sapiens
gactccagagacacttacatgaaataattaactatctcattcagtaaacaggaagtaaatcaatggacaaatgagtaactcttcctctggctgcctcttaggttttttgagaccacgccccttgggagcatcctgaacagattttcatctgactgtaacaccatcgacca

SEQ ID NO: 3448 - DNA, 170 bp, Homo sapiens
cagaggatgccagacccatgaatgactccagagacacttacatgaaataattaactatctcattcagtaaacaggaagtaaatcaatggacaaatgagtaactcttcctctggctgcctcttaggttttttgagaccacgccccttgggagcatcctgaacagattttca

SEQ ID NO: 3449 - DNA, 170 bp, Homo sapiens
tacttccgggtggcgtccaggtgatggcctcaggggtgaggggtgggaggtgctttgcaatgtgcagtttggtgtacttgctagactcatcgttatgagagtaatagggtcgtgttccctccaaaaaataaaaacaaaaaacagaaatgaaggaaatagaaatatccaca

SEQ ID NO: 3450 - DNA, 170 bp, Homo sapiens
tcgtgtgctacttcatccagaagtacttccgggtggcgtccaggtgatggcctcaggggtgaggggtgggaggtgctttgcaatgtgcagtttggtgtacttgctagactcatcgttatgagagtaatagggtcgtgttccctccaaaaaataaaaacaaaaaacagaaa

SEQ ID NO: 3451 - DNA, 170 bp, Homo sapiens
tctcaaaaaaataaaggatcaaaaaataaagtgagagcaaaacatggcggccagtagcactctaaacacagtcaataccaaaattcacctcactctctccccctcgtctccctcagcacatcccatccacgctggagtgcctgagccgctccaccctgctctgtgtctca

SEQ ID NO: 3452 - DNA, 170 bp, Homo sapiens
gtctgggcaacagtgagactcagtctcaaaaaaataaaggatcaaaaaataaagtgagagcaaaacatggcggccagtagcactctaaacacagtcaataccaaaattcacctcactctctccccctcgtctccctcagcacatcccatccacgctggagtgcctgagcc

SEQ ID NO: 3453 - DNA, 170 bp, Homo sapiens
tcgtggccctcttgcccctggccatcgtgtgctacttcatccagaagtacttccgggtggcgtccaggtgatggcctcaggggtgaggggtgggaggtgctttgcaatgtgcagtttggtgtacttgctagactcatcgttatgagagtaatagggtcgtgttccctcca

SEQ ID NO: 3454 - DNA, 170 bp, Homo sapiens
ccgtcatctcctatgtcacacctgtgttcctcgtggccctcttgcccctggccatcgtgtgctacttcatccagaagtacttccgggtggcgtccaggtgatggcctcaggggtgaggggtgggaggtgctttgcaatgtgcagtttggtgtacttgctagactcatcgt

SEQ ID NO: 3455 - DNA, 170 bp, Homo sapiens
tgctctgtgtctcagccctggccgtcatctcctatgtcacacctgtgttcctcgtggccctcttgcccctggccatcgtgtgctacttcatccagaagtacttccgggtggcgtccaggtgatggcctcaggggtgaggggtgggaggtgctttgcaatgtgcagtttgg

SEQ ID NO: 3456 - DNA, 170 bp, Homo sapiens
cgctggagtgcctgagccgctccaccctgctctgtgtctcagccctggccgtcatctcctatgtcacacctgtgttcctcgtggccctcttgcccctggccatcgtgtgctacttcatccagaagtacttccgggtggcgtccaggtgatggcctcaggggtgaggggtg

SEQ ID NO: 3457 - DNA, 170 bp, Homo sapiens
tcgtctccctcagcacatcccatccacgctggagtgcctgagccgctccaccctgctctgtgtctcagccctggccgtcatctcctatgtcacacctgtgttcctcgtggccctcttgcccctggccatcgtgtgctacttcatccagaagtacttccgggtggcgtcca

SEQ ID NO: 3458 - DNA, 170 bp, Homo sapiens
accaaaattcacctcactctctccccctcgtctccctcagcacatcccatccacgctggagtgcctgagccgctccaccctgctctgtgtctcagccctggccgtcatctcctatgtcacacctgtgttcctcgtggccctcttgcccctggccatcgtgtgctacttca

SEQ ID NO: 3459 - DNA, 170 bp, Homo sapiens
agtagcactctaaacacagtcaataccaaaattcacctcactctctccccctcgtctccctcagcacatcccatccacgctggagtgcctgagccgctccaccctgctctgtgtctcagccctggccgtcatctcctatgtcacacctgtgttcctcgtggccctcttgc

SEQ ID NO: 3460 - DNA, 170 bp, Homo sapiens
agtgagagcaaaacatggcggccagtagcactctaaacacagtcaataccaaaattcacctcactctctccccctcgtctccctcagcacatcccatccacgctggagtgcctgagccgctccaccctgctctgtgtctcagccctggccgtcatctcctatgtcacacc

SEQ ID NO: 3461 - DNA, 170 bp, Homo sapiens
ccgtagaaggactcaccaccatccgggccttcaggtacgagtccacattcccccaaggtaggagtggaacaggggtggggccagggggcacaggccatgagatttgattctcaggactccacttgggaaggccaaggacacgttctctctcaagctgcctcaggtcccaa

SEQ ID NO: 3462 - DNA, 170 bp, Homo sapiens
ccacttctctcacactttgccgaaaccgtagaaggactcaccaccatccgggccttcaggtacgagtccacattcccccaaggtaggagtggaacaggggtggggccagggggcacaggccatgagatttgattctcaggactccacttgggaaggccaaggacacgttc

SEQ ID NO: 3463 - DNA, 170 bp, Homo sapiens
gctggatgacaccacccagcttccacttctctcacactttgccgaaaccgtagaaggactcaccaccatccgggccttcaggtacgagtccacattcccccaaggtaggagtggaacaggggtggggccagggggcacaggccatgagatttgattctcaggactccact

SEQ ID NO: 3464 - DNA, 170 bp, Homo sapiens
ctctgttccccgccacagggacctgcagcagctggatgacaccacccagcttccacttctctcacactttgccgaaaccgtagaaggactcaccaccatccgggccttcaggtacgagtccacattcccccaaggtaggagtggaacaggggtggggccagggggcacag

SEQ ID NO: 3465 - DNA, 170 bp, Homo sapiens
gcctgccctcttaactgttccactctgttccccgccacagggacctgcagcagctggatgacaccacccagcttccacttctctcacactttgccgaaaccgtagaaggactcaccaccatccgggccttcaggtacgagtccacattcccccaaggtaggagtggaaca

SEQ ID NO: 3466 - DNA, 170 bp, Homo sapiens
aggcccaggccgagccctgagcctgccctcttaactgttccactctgttccccgccacagggacctgcagcagctggatgacaccacccagcttccacttctctcacactttgccgaaaccgtagaaggactcaccaccatccgggccttcaggtacgagtccacattcc

SEQ ID NO: 3467 - DNA, 170 bp, Homo sapiens
cagcggtagcaggtggagctaggcttcaggcccaggccgagccctgagcctgccctcttaactgttccactctgttccccgccacagggacctgcagcagctggatgacaccacccagcttccacttctctcacactttgccgaaaccgtagaaggactcaccaccatcc

SEQ ID NO: 3468 - DNA, 170 bp, Homo sapiens
cctagagaggtaaggccattcacccacacagcggtagcaggtggagctaggcttcaggcccaggccgagccctgagcctgccctcttaactgttccactctgttccccgccacagggacctgcagcagctggatgacaccacccagcttccacttctctcacactttgcc

SEQ ID NO: 3469 - DNA, 170 bp, Homo sapiens
cccttcacggggtaagaagctgaggcctagagaggtaaggccattcacccacacagcggtagcaggtggagctaggcttcaggcccaggccgagccctgagcctgccctcttaactgttccactctgttccccgccacagggacctgcagcagctggatgacaccaccca

SEQ ID NO: 3470 - DNA, 170 bp, Homo sapiens
gacttccaacttccccaagctgctaattggtaggtgaggtgtaggagggaggggcagtaccttcattcatttcttcagataatgtttactgaggactcattatgtgccagctattgctctaaacagtagagatttggaatagaaaaagaaaaaaatccctgccttcatgg

SEQ ID NO: 3471 - DNA, 170 bp, Homo sapiens
ctccgtggtctactatcacaacatcgagacttccaacttccccaagctgctaattggtaggtgaggtgtaggagggaggggcagtaccttcattcatttcttcagataatgtttactgaggactcattatgtgccagctattgctctaaacagtagagatttggaataga

SEQ ID NO: 3472 - DNA, 170 bp, Homo sapiens
atggcgttcatggctgctgtcacctccgtggtctactatcacaacatcgagacttccaacttccccaagctgctaattggtaggtgaggtgtaggagggaggggcagtaccttcattcatttcttcagataatgtttactgaggactcattatgtgccagctattgctct

SEQ ID NO: 3473 - DNA, 170 bp, Homo sapiens
tgcacctgtacatgccagccgggatggcgttcatggctgctgtcacctccgtggtctactatcacaacatcgagacttccaacttccccaagctgctaattggtaggtgaggtgtaggagggaggggcagtaccttcattcatttcttcagataatgtttactgaggact

SEQ ID NO: 3474 - DNA, 170 bp, Homo sapiens
ccatctcagggtgaccgaatcccaccatctgcacctgtacatgccagccgggatggcgttcatggctgctgtcacctccgtggtctactatcacaacatcgagacttccaacttccccaagctgctaattggtaggtgaggtgtaggagggaggggcagtaccttcattc

SEQ ID NO: 3475 - DNA, 170 bp, Homo sapiens
gtccccatcctgtctgtttctctctcccatctcagggtgaccgaatcccaccatctgcacctgtacatgccagccgggatggcgttcatggctgctgtcacctccgtggtctactatcacaacatcgagacttccaacttccccaagctgctaattggtaggtgaggtgt

SEQ ID NO: 3476 - DNA, 170 bp, Homo sapiens
ggctgctctattgcagtacttagcatgtccccatcctgtctgtttctctctcccatctcagggtgaccgaatcccaccatctgcacctgtacatgccagccgggatggcgttcatggctgctgtcacctccgtggtctactatcacaacatcgagacttccaacttcccc

SEQ ID NO: 3477 - DNA, 170 bp, Homo sapiens
ttcagcctttgaaattcaaggcctgggctgctctattgcagtacttagcatgtccccatcctgtctgtttctctctcccatctcagggtgaccgaatcccaccatctgcacctgtacatgccagccgggatggcgttcatggctgctgtcacctccgtggtctactatca

SEQ ID NO: 3478 - DNA, 170 bp, Homo sapiens
ctataaagtgatgctataaaggttcagtgttcagcctttgaaattcaaggcctgggctgctctattgcagtacttagcatgtccccatcctgtctgtttctctctcccatctcagggtgaccgaatcccaccatctgcacctgtacatgccagccgggatggcgttcatg

SEQ ID NO: 3479 - DNA, 170 bp, Homo sapiens
actaaagggccctgcagcctataaagtgatgctataaaggttcagtgttcagcctttgaaattcaaggcctgggctgctctattgcagtacttagcatgtccccatcctgtctgtttctctctcccatctcagggtgaccgaatcccaccatctgcacctgtacatgcca

SEQ ID NO: 3480 - DNA, 170 bp, Homo sapiens
acagatggctggaagtccgaatggcaagtgctattcccctctaccctggcctctgataggagggtggggccagagcaagagcacacaggtacctggggatgaaagagaggataggataccagatcgtgtggacaccaagccttcctgcttcccccagccctggtggtcct

SEQ ID NO: 3481 - DNA, 170 bp, Homo sapiens
tccctcttcctcacagctgccaacagatggctggaagtccgaatggcaagtgctattcccctctaccctggcctctgataggagggtggggccagagcaagagcacacaggtacctggggatgaaagagaggataggataccagatcgtgtggacaccaagccttcctgc

SEQ ID NO: 3482 - DNA, 170 bp, Homo sapiens
acacagactccaacaacattgcttccctcttcctcacagctgccaacagatggctggaagtccgaatggcaagtgctattcccctctaccctggcctctgataggagggtggggccagagcaagagcacacaggtacctggggatgaaagagaggataggataccagatc

SEQ ID NO: 3483 - DNA, 170 bp, Homo sapiens
cccggttccagcagaagcttctcgaatacacagactccaacaacattgcttccctcttcctcacagctgccaacagatggctggaagtccgaatggcaagtgctattcccctctaccctggcctctgataggagggtggggccagagcaagagcacacaggtacctgggg

SEQ ID NO: 3484 - DNA, 170 bp, Homo sapiens
ttctcatcctccctccaggtatgaggcccggttccagcagaagcttctcgaatacacagactccaacaacattgcttccctcttcctcacagctgccaacagatggctggaagtccgaatggcaagtgctattcccctctaccctggcctctgataggagggtggggcca

SEQ ID NO: 3485 - DNA, 170 bp, Homo sapiens
ggaccaacactgttcccttaggagcttctcatcctccctccaggtatgaggcccggttccagcagaagcttctcgaatacacagactccaacaacattgcttccctcttcctcacagctgccaacagatggctggaagtccgaatggcaagtgctattcccctctaccct

SEQ ID NO: 3486 - DNA, 170 bp, Homo sapiens
agggagactcctaggagctatgtggaccaacactgttcccttaggagcttctcatcctccctccaggtatgaggcccggttccagcagaagcttctcgaatacacagactccaacaacattgcttccctcttcctcacagctgccaacagatggctggaagtccgaatgg

SEQ ID NO: 3487 - DNA, 170 bp, Homo sapiens
gccctggagcctccctctgcaggtagggagactcctaggagctatgtggaccaacactgttcccttaggagcttctcatcctccctccaggtatgaggcccggttccagcagaagcttctcgaatacacagactccaacaacattgcttccctcttcctcacagctgcca

SEQ ID NO: 3488 - DNA, 170 bp, Homo sapiens
ggtggcatgtctggggactggaggggccctggagcctccctctgcaggtagggagactcctaggagctatgtggaccaacactgttcccttaggagcttctcatcctccctccaggtatgaggcccggttccagcagaagcttctcgaatacacagactccaacaacatt

SEQ ID NO: 3489 - DNA, 170 bp, Homo sapiens
ccagagagggatagcttacatgaagtggccacggtggcatgtctggggactggaggggccctggagcctccctctgcaggtagggagactcctaggagctatgtggaccaacactgttcccttaggagcttctcatcctccctccaggtatgaggcccggttccagcaga

SEQ ID NO: 3490 - DNA, 170 bp, Homo sapiens
tgctggcctggtgggcctgggccttacctacgccctaatggtgagcggcagtgggctagggcagaggaggggtcagacaccagcactcccggagcaccttcgtcactggagacatgagacactcccaggccttaccccaatttcatttgcatctgatgccagagggacag

SEQ ID NO: 3491 - DNA, 170 bp, Homo sapiens
catctccaactccctgcacagggagctctctgctggcctggtgggcctgggccttacctacgccctaatggtgagcggcagtgggctagggcagaggaggggtcagacaccagcactcccggagcaccttcgtcactggagacatgagacactcccaggccttaccccaa

SEQ ID NO: 3492 - DNA, 170 bp, Homo sapiens
gctcatcgcagcggtgacctccatctccaactccctgcacagggagctctctgctggcctggtgggcctgggccttacctacgccctaatggtgagcggcagtgggctagggcagaggaggggtcagacaccagcactcccggagcaccttcgtcactggagacatgaga

SEQ ID NO: 3493 - DNA, 170 bp, Homo sapiens
cccaggagtacatcggtgcatgtgtggtgctcatcgcagcggtgacctccatctccaactccctgcacagggagctctctgctggcctggtgggcctgggccttacctacgccctaatggtgagcggcagtgggctagggcagaggaggggtcagacaccagcactcccg

SEQ ID NO: 3494 - DNA, 170 bp, Homo sapiens
cgcccaggtcagctcctctccctccccaggagtacatcggtgcatgtgtggtgctcatcgcagcggtgacctccatctccaactccctgcacagggagctctctgctggcctggtgggcctgggccttacctacgccctaatggtgagcggcagtgggctagggcagagg

SEQ ID NO: 3495 - DNA, 170 bp, Homo sapiens
gggcctgtggctctaacccctgagcgcccaggtcagctcctctccctccccaggagtacatcggtgcatgtgtggtgctcatcgcagcggtgacctccatctccaactccctgcacagggagctctctgctggcctggtgggcctgggccttacctacgccctaatggtg

SEQ ID NO: 3496 - DNA, 170 bp, Homo sapiens
gccccgaaaaggagtgaggtagaacaggggcctgtggctctaacccctgagcgcccaggtcagctcctctccctccccaggagtacatcggtgcatgtgtggtgctcatcgcagcggtgacctccatctccaactccctgcacagggagctctctgctggcctggtgggc

SEQ ID NO: 3497 - DNA, 170 bp, Homo sapiens
tggaggcctggctgagctgctctctgccccgaaaaggagtgaggtagaacaggggcctgtggctctaacccctgagcgcccaggtcagctcctctccctccccaggagtacatcggtgcatgtgtggtgctcatcgcagcggtgacctccatctccaactccctgcacag

SEQ ID NO: 3498 - DNA, 170 bp, Homo sapiens
gtgtgcatgagttgcagggctggagtggaggcctggctgagctgctctctgccccgaaaaggagtgaggtagaacaggggcctgtggctctaacccctgagcgcccaggtcagctcctctccctccccaggagtacatcggtgcatgtgtggtgctcatcgcagcggtga

SEQ ID NO: 3499 - DNA, 170 bp, Homo sapiens
accgaggcagagagctacgaggggctcctgggtgagaggctcagggagaggggtggggaagagtccaaggaggagtgtgtctgggttgggggccacaagggagcctggggatggggtggcactttcggatactagctgtggcccatgcctggtggctgagcccagcccgg

SEQ ID NO: 3500 - DNA, 170 bp, Homo sapiens
cgcatccatgggctcctgaaaaccgaggcagagagctacgaggggctcctgggtgagaggctcagggagaggggtggggaagagtccaaggaggagtgtgtctgggttgggggccacaagggagcctggggatggggtggcactttcggatactagctgtggcccatgcc

SEQ ID NO: 3501 - DNA, 170 bp, Homo sapiens
agctccagctgggggctgtgaagcgcatccatgggctcctgaaaaccgaggcagagagctacgaggggctcctgggtgagaggctcagggagaggggtggggaagagtccaaggaggagtgtgtctgggttgggggccacaagggagcctggggatggggtggcactttc

SEQ ID NO: 3502 - DNA, 170 bp, Homo sapiens
tggatggtgaggaacctggcagacatggagctccagctgggggctgtgaagcgcatccatgggctcctgaaaaccgaggcagagagctacgaggggctcctgggtgagaggctcagggagaggggtggggaagagtccaaggaggagtgtgtctgggttgggggccacaa

SEQ ID NO: 3503 - DNA, 170 bp, Homo sapiens
cccacaggtctccaactacctcaactggatggtgaggaacctggcagacatggagctccagctgggggctgtgaagcgcatccatgggctcctgaaaaccgaggcagagagctacgaggggctcctgggtgagaggctcagggagaggggtggggaagagtccaaggagg

SEQ ID NO: 3504 - DNA, 170 bp, Homo sapiens
gagtgtgcgccactggcttgctccccacaggtctccaactacctcaactggatggtgaggaacctggcagacatggagctccagctgggggctgtgaagcgcatccatgggctcctgaaaaccgaggcagagagctacgaggggctcctgggtgagaggctcagggagag

SEQ ID NO: 3505 - DNA, 170 bp, Homo sapiens
ggctgaggacagaactaagcgaccatggagtgtgcgccactggcttgctccccacaggtctccaactacctcaactggatggtgaggaacctggcagacatggagctccagctgggggctgtgaagcgcatccatgggctcctgaaaaccgaggcagagagctacgaggg

SEQ ID NO: 3506 - DNA, 170 bp, Homo sapiens
tccagccttaagaagagccattctggtggctgaggacagaactaagcgaccatggagtgtgcgccactggcttgctccccacaggtctccaactacctcaactggatggtgaggaacctggcagacatggagctccagctgggggctgtgaagcgcatccatgggctcct

SEQ ID NO: 3507 - DNA, 170 bp, Homo sapiens
gaatctggggccctggcccctctccagccttaagaagagccattctggtggctgaggacagaactaagcgaccatggagtgtgcgccactggcttgctccccacaggtctccaactacctcaactggatggtgaggaacctggcagacatggagctccagctgggggctg

SEQ ID NO: 3508 - DNA, 170 bp, Homo sapiens
gcaggcagtggatggcagcaaaaggaatctggggccctggcccctctccagccttaagaagagccattctggtggctgaggacagaactaagcgaccatggagtgtgcgccactggcttgctccccacaggtctccaactacctcaactggatggtgaggaacctggcag

SEQ ID NO: 3509 - DNA, 170 bp, Homo sapiens
gcacgtcaatgccctcatcgcccctggacagaaggtcagagcacgggcccaacccaatgctgcaggacaggcgtgagcaggggatggggcatgcacggagctggatggcttcgcagtcacctcgtggccctccagggccgaggcctctcactattcagacatcgcagtct

SEQ ID NO: 3510 - DNA, 170 bp, Homo sapiens
tacgacagctccctgaagccggtgctgaagcacgtcaatgccctcatcgcccctggacagaaggtcagagcacgggcccaacccaatgctgcaggacaggcgtgagcaggggatggggcatgcacggagctggatggcttcgcagtcacctcgtggccctccagggccga

SEQ ID NO: 3511 - DNA, 170 bp, Homo sapiens
atccagaacctgagcgtgcgctacgacagctccctgaagccggtgctgaagcacgtcaatgccctcatcgcccctggacagaaggtcagagcacgggcccaacccaatgctgcaggacaggcgtgagcaggggatggggcatgcacggagctggatggcttcgcagtcac

SEQ ID NO: 3512 - DNA, 170 bp, Homo sapiens
actggccagaccaagggaagatccagatccagaacctgagcgtgcgctacgacagctccctgaagccggtgctgaagcacgtcaatgccctcatcgcccctggacagaaggtcagagcacgggcccaacccaatgctgcaggacaggcgtgagcaggggatggggcatgc

SEQ ID NO: 3513 - DNA, 170 bp, Homo sapiens
agcaccatcgctgatcccaaagaactggccagaccaagggaagatccagatccagaacctgagcgtgcgctacgacagctccctgaagccggtgctgaagcacgtcaatgccctcatcgcccctggacagaaggtcagagcacgggcccaacccaatgctgcaggacagg

SEQ ID NO: 3514 - DNA, 170 bp, Homo sapiens
gtggctgagcccagcccggcccccagcaccatcgctgatcccaaagaactggccagaccaagggaagatccagatccagaacctgagcgtgcgctacgacagctccctgaagccggtgctgaagcacgtcaatgccctcatcgcccctggacagaaggtcagagcacggg

SEQ ID NO: 3515 - DNA, 170 bp, Homo sapiens
ttcggatactagctgtggcccatgcctggtggctgagcccagcccggcccccagcaccatcgctgatcccaaagaactggccagaccaagggaagatccagatccagaacctgagcgtgcgctacgacagctccctgaagccggtgctgaagcacgtcaatgccctcatc

SEQ ID NO: 3516 - DNA, 170 bp, Homo sapiens
gagcctggggatggggtggcactttcggatactagctgtggcccatgcctggtggctgagcccagcccggcccccagcaccatcgctgatcccaaagaactggccagaccaagggaagatccagatccagaacctgagcgtgcgctacgacagctccctgaagccggtgc

SEQ ID NO: 3517 - DNA, 170 bp, Homo sapiens
agtgtgtctgggttgggggccacaagggagcctggggatggggtggcactttcggatactagctgtggcccatgcctggtggctgagcccagcccggcccccagcaccatcgctgatcccaaagaactggccagaccaagggaagatccagatccagaacctgagcgtgc

SEQ ID NO: 3518 - DNA, 170 bp, Homo sapiens
ggggtggggaagagtccaaggaggagtgtgtctgggttgggggccacaagggagcctggggatggggtggcactttcggatactagctgtggcccatgcctggtggctgagcccagcccggcccccagcaccatcgctgatcccaaagaactggccagaccaagggaaga

SEQ ID NO: 3519 - DNA, 170 bp, Homo sapiens
tccgcatggtggacacgttcgaaggtgagttgtaaggcgggcaccccacgtgtacccacagccaccagatgaggcctcagccctggcacgtggtcagacatgacaggaggcccagcagtcaccgccttcccctgcaccctcactgggacccatgcagggcacatcatcat

SEQ ID NO: 3520 - DNA, 170 bp, Homo sapiens
tgggaagtcctccttctctcttgccttcttccgcatggtggacacgttcgaaggtgagttgtaaggcgggcaccccacgtgtacccacagccaccagatgaggcctcagccctggcacgtggtcagacatgacaggaggcccagcagtcaccgccttcccctgcaccctc

SEQ ID NO: 3521 - DNA, 170 bp, Homo sapiens
atctgcggccgcaccggcagtgggaagtcctccttctctcttgccttcttccgcatggtggacacgttcgaaggtgagttgtaaggcgggcaccccacgtgtacccacagccaccagatgaggcctcagccctggcacgtggtcagacatgacaggaggcccagcagtca

SEQ ID NO: 3522 - DNA, 170 bp, Homo sapiens
ctgcttctctctttccagatcgggatctgcggccgcaccggcagtgggaagtcctccttctctcttgccttcttccgcatggtggacacgttcgaaggtgagttgtaaggcgggcaccccacgtgtacccacagccaccagatgaggcctcagccctggcacgtggtcag

SEQ ID NO: 3523 - DNA, 170 bp, Homo sapiens
gcagccccagagtcccagtggcggtgcctgcttctctctttccagatcgggatctgcggccgcaccggcagtgggaagtcctccttctctcttgccttcttccgcatggtggacacgttcgaaggtgagttgtaaggcgggcaccccacgtgtacccacagccaccagat

SEQ ID NO: 3524 - DNA, 170 bp, Homo sapiens
cccagagctagcatagaggctattcccagcagccccagagtcccagtggcggtgcctgcttctctctttccagatcgggatctgcggccgcaccggcagtgggaagtcctccttctctcttgccttcttccgcatggtggacacgttcgaaggtgagttgtaaggcgggc

SEQ ID NO: 3525 - DNA, 170 bp, Homo sapiens
acctcccacacctgcacacacacccagagctagcatagaggctattcccagcagccccagagtcccagtggcggtgcctgcttctctctttccagatcgggatctgcggccgcaccggcagtgggaagtcctccttctctcttgccttcttccgcatggtggacacgttc

SEQ ID NO: 3526 - DNA, 170 bp, Homo sapiens
aaccaggccaaaaagataccctgtgacctcccacacctgcacacacacccagagctagcatagaggctattcccagcagccccagagtcccagtggcggtgcctgcttctctctttccagatcgggatctgcggccgcaccggcagtgggaagtcctccttctctcttgc

SEQ ID NO: 3527 - DNA, 170 bp, Homo sapiens
ctgtggtgtccaaagagaaactagtcagaaaaccaggccaaaaagataccctgtgacctcccacacctgcacacacacccagagctagcatagaggctattcccagcagccccagagtcccagtggcggtgcctgcttctctctttccagatcgggatctgcggccgcac

SEQ ID NO: 3528 - DNA, 170 bp, Homo sapiens
cctcttcagcggcaccatccggtgagccccaccacccctcaggcccacccagccccaggccggctcagttccatcagatctggagcacaaagaggagggggttgggggagaccaggatcccagaggtgtttcctgctcatgcccttctccatcccatcaggcccaggcag

SEQ ID NO: 3529 - DNA, 170 bp, Homo sapiens
tctccatcatcctgcaggaccccgtcctcttcagcggcaccatccggtgagccccaccacccctcaggcccacccagccccaggccggctcagttccatcagatctggagcacaaagaggagggggttgggggagaccaggatcccagaggtgtttcctgctcatgccct

SEQ ID NO: 3530 - DNA, 170 bp, Homo sapiens
ctgcacaccctgcgctcacgcctctccatcatcctgcaggaccccgtcctcttcagcggcaccatccggtgagccccaccacccctcaggcccacccagccccaggccggctcagttccatcagatctggagcacaaagaggagggggttgggggagaccaggatcccag

SEQ ID NO: 3531 - DNA, 170 bp, Homo sapiens
tggcattgacatcgccaaactgccgctgcacaccctgcgctcacgcctctccatcatcctgcaggaccccgtcctcttcagcggcaccatccggtgagccccaccacccctcaggcccacccagccccaggccggctcagttccatcagatctggagcacaaagaggagg

SEQ ID NO: 3532 - DNA, 170 bp, Homo sapiens
gacccatgcagggcacatcatcattgatggcattgacatcgccaaactgccgctgcacaccctgcgctcacgcctctccatcatcctgcaggaccccgtcctcttcagcggcaccatccggtgagccccaccacccctcaggcccacccagccccaggccggctcagttc

SEQ ID NO: 3533 - DNA, 170 bp, Homo sapiens
caccgccttcccctgcaccctcactgggacccatgcagggcacatcatcattgatggcattgacatcgccaaactgccgctgcacaccctgcgctcacgcctctccatcatcctgcaggaccccgtcctcttcagcggcaccatccggtgagccccaccacccctcaggc

SEQ ID NO: 3534 - DNA, 170 bp, Homo sapiens
agacatgacaggaggcccagcagtcaccgccttcccctgcaccctcactgggacccatgcagggcacatcatcattgatggcattgacatcgccaaactgccgctgcacaccctgcgctcacgcctctccatcatcctgcaggaccccgtcctcttcagcggcaccatcc

SEQ ID NO: 3535 - DNA, 170 bp, Homo sapiens
gcctcagccctggcacgtggtcagacatgacaggaggcccagcagtcaccgccttcccctgcaccctcactgggacccatgcagggcacatcatcattgatggcattgacatcgccaaactgccgctgcacaccctgcgctcacgcctctccatcatcctgcaggacccc

SEQ ID NO: 3536 - DNA, 170 bp, Homo sapiens
ccacgtgtacccacagccaccagatgaggcctcagccctggcacgtggtcagacatgacaggaggcccagcagtcaccgccttcccctgcaccctcactgggacccatgcagggcacatcatcattgatggcattgacatcgccaaactgccgctgcacaccctgcgctc

SEQ ID NO: 3537 - DNA, 170 bp, Homo sapiens
gaaggtgagttgtaaggcgggcaccccacgtgtacccacagccaccagatgaggcctcagccctggcacgtggtcagacatgacaggaggcccagcagtcaccgccttcccctgcaccctcactgggacccatgcagggcacatcatcattgatggcattgacatcgcca

SEQ ID NO: 3538 - DNA, 170 bp, Homo sapiens
tgaagctggtggtgaaggcactgccaggaggcctcggtaactactcctggctatgcagctgggttggttgggcactcaaggaccctgtaaggatggcagacagaagcccgtgtctcaggtttgccccaagtttggagtctgaagcctggcaggaccatttagtcctactt

SEQ ID NO: 3539 - DNA, 170 bp, Homo sapiens
tgggaggccctggaaatcgcccagctgaagctggtggtgaaggcactgccaggaggcctcggtaactactcctggctatgcagctgggttggttgggcactcaaggaccctgtaaggatggcagacagaagcccgtgtctcaggtttgccccaagtttggagtctgaagc

SEQ ID NO: 3540 - DNA, 170 bp, Homo sapiens
tgagaggaagtgctcagatagcacactgtgggaggccctggaaatcgcccagctgaagctggtggtgaaggcactgccaggaggcctcggtaactactcctggctatgcagctgggttggttgggcactcaaggaccctgtaaggatggcagacagaagcccgtgtctca

SEQ ID NO: 3541 - DNA, 170 bp, Homo sapiens
ccacttccagatttaacctggaccctgagaggaagtgctcagatagcacactgtgggaggccctggaaatcgcccagctgaagctggtggtgaaggcactgccaggaggcctcggtaactactcctggctatgcagctgggttggttgggcactcaaggaccctgtaagg

SEQ ID NO: 3542 - DNA, 170 bp, Homo sapiens
ccctccctactggggctttctgtgccacttccagatttaacctggaccctgagaggaagtgctcagatagcacactgtgggaggccctggaaatcgcccagctgaagctggtggtgaaggcactgccaggaggcctcggtaactactcctggctatgcagctgggttggt

SEQ ID NO: 3543 - DNA, 170 bp, Homo sapiens
ggatgcaggcaggaccctgctccctccctactggggctttctgtgccacttccagatttaacctggaccctgagaggaagtgctcagatagcacactgtgggaggccctggaaatcgcccagctgaagctggtggtgaaggcactgccaggaggcctcggtaactactcc

SEQ ID NO: 3544 - DNA, 170 bp, Homo sapiens
ctcgctcactgccctctttgccgcctggggatgcaggcaggaccctgctccctccctactggggctttctgtgccacttccagatttaacctggaccctgagaggaagtgctcagatagcacactgtgggaggccctggaaatcgcccagctgaagctggtggtgaaggc

SEQ ID NO: 3545 - DNA, 170 bp, Homo sapiens
cagccagacctccaactcagtctgctctcgctcactgccctctttgccgcctggggatgcaggcaggaccctgctccctccctactggggctttctgtgccacttccagatttaacctggaccctgagaggaagtgctcagatagcacactgtgggaggccctggaaatc

SEQ ID NO: 3546 - DNA, 170 bp, Homo sapiens
ccaccacctcggtgcttctcccagccagacctccaactcagtctgctctcgctcactgccctctttgccgcctggggatgcaggcaggaccctgctccctccctactggggctttctgtgccacttccagatttaacctggaccctgagaggaagtgctcagatagcaca

SEQ ID NO: 3547 - DNA, 170 bp, Homo sapiens
tcatggacgaggccacggcttccattgacatggccacggttggtcctgggcccctccatgggaccatggtcttggaaagggtttagtgggatgctagggagaaatttgcacgaagtagtcctgaggctcaagttgcctctaacatcaaatgctatgtgttgcagaaaatg

SEQ ID NO: 3548 - DNA, 170 bp, Homo sapiens
gccttcgtgaggaagaccagcatcttcatcatggacgaggccacggcttccattgacatggccacggttggtcctgggcccctccatgggaccatggtcttggaaagggtttagtgggatgctagggagaaatttgcacgaagtagtcctgaggctcaagttgcctctaa

SEQ ID NO: 3549 - DNA, 170 bp, Homo sapiens
ggcagctgttctgcctggcccgggccttcgtgaggaagaccagcatcttcatcatggacgaggccacggcttccattgacatggccacggttggtcctgggcccctccatgggaccatggtcttggaaagggtttagtgggatgctagggagaaatttgcacgaagtagt

SEQ ID NO: 3550 - DNA, 170 bp, Homo sapiens
gggagaatttcagccagggacagaggcagctgttctgcctggcccgggccttcgtgaggaagaccagcatcttcatcatggacgaggccacggcttccattgacatggccacggttggtcctgggcccctccatgggaccatggtcttggaaagggtttagtgggatgct

SEQ ID NO: 3551 - DNA, 170 bp, Homo sapiens
gctgttttcagatgccatcatcacagaaggcggggagaatttcagccagggacagaggcagctgttctgcctggcccgggccttcgtgaggaagaccagcatcttcatcatggacgaggccacggcttccattgacatggccacggttggtcctgggcccctccatggga

SEQ ID NO: 3552 - DNA, 170 bp, Homo sapiens
tcagtcctacttcatctccccgggctgttttcagatgccatcatcacagaaggcggggagaatttcagccagggacagaggcagctgttctgcctggcccgggccttcgtgaggaagaccagcatcttcatcatggacgaggccacggcttccattgacatggccacggt

SEQ ID NO: 3553 - DNA, 170 bp, Homo sapiens
tccactcacagcacaagattaactcagtcctacttcatctccccgggctgttttcagatgccatcatcacagaaggcggggagaatttcagccagggacagaggcagctgttctgcctggcccgggccttcgtgaggaagaccagcatcttcatcatggacgaggccacg

SEQ ID NO: 3554 - DNA, 170 bp, Homo sapiens
gccccccaagccatcccatctgctccactcacagcacaagattaactcagtcctacttcatctccccgggctgttttcagatgccatcatcacagaaggcggggagaatttcagccagggacagaggcagctgttctgcctggcccgggccttcgtgaggaagaccagca

SEQ ID NO: 3555 - DNA, 170 bp, Homo sapiens
tttgcccccatgcacacattttccaacagccccccaagccatcccatctgctccactcacagcacaagattaactcagtcctacttcatctccccgggctgttttcagatgccatcatcacagaaggcggggagaatttcagccagggacagaggcagctgttctgcctg

SEQ ID NO: 3556 - DNA, 170 bp, Homo sapiens
gtgctcttggacacacacccacctatttgcccccatgcacacattttccaacagccccccaagccatcccatctgctccactcacagcacaagattaactcagtcctacttcatctccccgggctgttttcagatgccatcatcacagaaggcggggagaatttcagcca

SEQ ID NO: 3557 - DNA, 170 bp, Homo sapiens
gcactgtggtcaccatcgcggtaaggggcccattgatggggtgcagagggacacccagggacaggactggcctgttgtggccgtcatcagtgcacagcccctgggcttgcctggtcccagtaatcaagaaagaaccctgaagcaggcagttcagggcaaggggcctggag

SEQ ID NO: 3558 - DNA, 170 bp, Homo sapiens
ggtgatgacagccttcgcagaccgcactgtggtcaccatcgcggtaaggggcccattgatggggtgcagagggacacccagggacaggactggcctgttgtggccgtcatcagtgcacagcccctgggcttgcctggtcccagtaatcaagaaagaaccctgaagcaggc

SEQ ID NO: 3559 - DNA, 170 bp, Homo sapiens
cacttggcaggaaaacatcctccaaaaggtggtgatgacagccttcgcagaccgcactgtggtcaccatcgcggtaaggggcccattgatggggtgcagagggacacccagggacaggactggcctgttgtggccgtcatcagtgcacagcccctgggcttgcctggtcc

SEQ ID NO: 3560 - DNA, 170 bp, Homo sapiens
gtgagccaacagctgttgcccccacttggcaggaaaacatcctccaaaaggtggtgatgacagccttcgcagaccgcactgtggtcaccatcgcggtaaggggcccattgatggggtgcagagggacacccagggacaggactggcctgttgtggccgtcatcagtgcac

SEQ ID NO: 3561 - DNA, 170 bp, Homo sapiens
aggccagaccccatccactgggcaggtgagccaacagctgttgcccccacttggcaggaaaacatcctccaaaaggtggtgatgacagccttcgcagaccgcactgtggtcaccatcgcggtaaggggcccattgatggggtgcagagggacacccagggacaggactgg

SEQ ID NO: 3562 - DNA, 170 bp, Homo sapiens
gacctgggctccacatcccccaagccaggccagaccccatccactgggcaggtgagccaacagctgttgcccccacttggcaggaaaacatcctccaaaaggtggtgatgacagccttcgcagaccgcactgtggtcaccatcgcggtaaggggcccattgatggggtgc

SEQ ID NO: 3563 - DNA, 170 bp, Homo sapiens
ggggtcagatgggagctgagccacagacctgggctccacatcccccaagccaggccagaccccatccactgggcaggtgagccaacagctgttgcccccacttggcaggaaaacatcctccaaaaggtggtgatgacagccttcgcagaccgcactgtggtcaccatcgc

SEQ ID NO: 3564 - DNA, 170 bp, Homo sapiens
ggggtgggggtgggactaggatcggggtcagatgggagctgagccacagacctgggctccacatcccccaagccaggccagaccccatccactgggcaggtgagccaacagctgttgcccccacttggcaggaaaacatcctccaaaaggtggtgatgacagccttcgca

SEQ ID NO: 3565 - DNA, 170 bp, Homo sapiens
gacagcgtcttcgcctccttcgtccgtgcagacaagtgacctgccagagcccaagtgccatcccacattcggaccctgcccatacccctgcctgggttttctaactgtaaatcacttgtaaataaatagatttgattatttcctactagaggccctaagtctggtgggca

SEQ ID NO: 3566 - DNA, 170 bp, Homo sapiens
cagagaagctgctcagccggaaggacagcgtcttcgcctccttcgtccgtgcagacaagtgacctgccagagcccaagtgccatcccacattcggaccctgcccatacccctgcctgggttttctaactgtaaatcacttgtaaataaatagatttgattatttcctact

SEQ ID NO: 3567 - DNA, 170 bp, Homo sapiens
gggtgccatccttgagttcgataagccagagaagctgctcagccggaaggacagcgtcttcgcctccttcgtccgtgcagacaagtgacctgccagagcccaagtgccatcccacattcggaccctgcccatacccctgcctgggttttctaactgtaaatcacttgtaa

SEQ ID NO: 3568 - DNA, 170 bp, Homo sapiens
tgcagacctggtgatcgtcctgaagcggggtgccatccttgagttcgataagccagagaagctgctcagccggaaggacagcgtcttcgcctccttcgtccgtgcagacaagtgacctgccagagcccaagtgccatcccacattcggaccctgcccatacccctgcctg

SEQ ID NO: 3569 - DNA, 170 bp, Homo sapiens
gcatcgagtgcacaccatcctgagtgcagacctggtgatcgtcctgaagcggggtgccatccttgagttcgataagccagagaagctgctcagccggaaggacagcgtcttcgcctccttcgtccgtgcagacaagtgacctgccagagcccaagtgccatcccacattc

SEQ ID NO: 3570 - DNA, 170 bp, Homo sapiens
cgccccctcctgccctgcccagcatcgagtgcacaccatcctgagtgcagacctggtgatcgtcctgaagcggggtgccatccttgagttcgataagccagagaagctgctcagccggaaggacagcgtcttcgcctccttcgtccgtgcagacaagtgacctgccagag

SEQ ID NO: 3571 - DNA, 170 bp, Homo sapiens
ccgcgggtggtattcccaccatcctgacccgccccctcctgccctgcccagcatcgagtgcacaccatcctgagtgcagacctggtgatcgtcctgaagcggggtgccatccttgagttcgataagccagagaagctgctcagccggaaggacagcgtcttcgcctcctt

SEQ ID NO: 3572 - DNA, 170 bp, Homo sapiens
ggccaccctcagctgtggcccccaccgcgggtggtattcccaccatcctgacccgccccctcctgccctgcccagcatcgagtgcacaccatcctgagtgcagacctggtgatcgtcctgaagcggggtgccatccttgagttcgataagccagagaagctgctcagccg

SEQ ID NO: 3573 - DNA, 170 bp, Homo sapiens
tcatcctcctcctccaagccgcaggagggccaccctcagctgtggcccccaccgcgggtggtattcccaccatcctgacccgccccctcctgccctgcccagcatcgagtgcacaccatcctgagtgcagacctggtgatcgtcctgaagcggggtgccatccttgagtt

SEQ ID NO: 3574 - DNA, 170 bp, Homo sapiens
tgacaggacattctggccacatgcctcatcctcctcctccaagccgcaggagggccaccctcagctgtggcccccaccgcgggtggtattcccaccatcctgacccgccccctcctgccctgcccagcatcgagtgcacaccatcctgagtgcagacctggtgatcgtcc

SEQ ID NO: 3575 - DNA, 170 bp, Homo sapiens
cgtggaggtcaatgtcatcagggtgagggtaagcaggccacctgggccagggtggggtgggaagcagaggctctggcctctgtcctgccctgggttcaggcccccaccctgcttctcagccaaactgagaagggatcagcttgttttacccgcccgtgtaaaggggagtg

SEQ ID NO: 3576 - DNA, 170 bp, Homo sapiens
atcctctatgggatgctgctcctcgtggaggtcaatgtcatcagggtgagggtaagcaggccacctgggccagggtggggtgggaagcagaggctctggcctctgtcctgccctgggttcaggcccccaccctgcttctcagccaaactgagaagggatcagcttgtttt

SEQ ID NO: 3577 - DNA, 170 bp, Homo sapiens
cacacccaggcacgcttattctgtctccttctctgccacatacttgcacacattatgtgagtgtacacacatgatgcacacacgtctctgcgatcttccatctctcctcggcagccctgctggtgtattggaccctggccttcatcaccaagaccatcaagtttgtcaag

SEQ ID NO: 3578 - DNA, 170 bp, Homo sapiens
acatccacttactcggaaatgtacacacccaggcacgcttattctgtctccttctctgccacatacttgcacacattatgtgagtgtacacacatgatgcacacacgtctctgcgatcttccatctctcctcggcagccctgctggtgtattggaccctggccttcatca

SEQ ID NO: 3579 - DNA, 170 bp, Homo sapiens
gcttctgcctcacagggctgctggtgatcctctatgggatgctgctcctcgtggaggtcaatgtcatcagggtgagggtaagcaggccacctgggccagggtggggtgggaagcagaggctctggcctctgtcctgccctgggttcaggcccccaccctgcttctcagcc

SEQ ID NO: 3580 - DNA, 170 bp, Homo sapiens
cgccatcggcttctcgcagctacgcttctgcctcacagggctgctggtgatcctctatgggatgctgctcctcgtggaggtcaatgtcatcagggtgagggtaagcaggccacctgggccagggtggggtgggaagcagaggctctggcctctgtcctgccctgggttca

SEQ ID NO: 3581 - DNA, 170 bp, Homo sapiens
accatcaagtttgtcaagttcttggaccacgccatcggcttctcgcagctacgcttctgcctcacagggctgctggtgatcctctatgggatgctgctcctcgtggaggtcaatgtcatcagggtgagggtaagcaggccacctgggccagggtggggtgggaagcagag

SEQ ID NO: 3582 - DNA, 170 bp, Homo sapiens
gtattggaccctggccttcatcaccaagaccatcaagtttgtcaagttcttggaccacgccatcggcttctcgcagctacgcttctgcctcacagggctgctggtgatcctctatgggatgctgctcctcgtggaggtcaatgtcatcagggtgagggtaagcaggccac

SEQ ID NO: 3583 - DNA, 170 bp, Homo sapiens
cggcagccctgctggtgtattggaccctggccttcatcaccaagaccatcaagtttgtcaagttcttggaccacgccatcggcttctcgcagctacgcttctgcctcacagggctgctggtgatcctctatgggatgctgctcctcgtggaggtcaatgtcatcagggtg

SEQ ID NO: 3584 - DNA, 170 bp, Homo sapiens
cacgtctctgcgatcttccatctctcctcggcagccctgctggtgtattggaccctggccttcatcaccaagaccatcaagtttgtcaagttcttggaccacgccatcggcttctcgcagctacgcttctgcctcacagggctgctggtgatcctctatgggatgctgct

SEQ ID NO: 3585 - DNA, 170 bp, Homo sapiens
atgtgagtgtacacacatgatgcacacacgtctctgcgatcttccatctctcctcggcagccctgctggtgtattggaccctggccttcatcaccaagaccatcaagtttgtcaagttcttggaccacgccatcggcttctcgcagctacgcttctgcctcacagggctg

SEQ ID NO: 3586 - DNA, 170 bp, Homo sapiens
ttctctgccacatacttgcacacattatgtgagtgtacacacatgatgcacacacgtctctgcgatcttccatctctcctcggcagccctgctggtgtattggaccctggccttcatcaccaagaccatcaagtttgtcaagttcttggaccacgccatcggcttctcgc

SEQ ID NO: 3587 - DNA, 170 bp, Homo sapiens
cgaggcctttgacgcccaggtggtcagtgggggcacagccacaccatctattcactgccttctggtttagggtcacagagagggacctcaaagggcattaggtcaaaatcctggtgggacaagaggggaaactgaggctggtgaggggaagaagcttgccttaagtcaca

SEQ ID NO: 3588 - DNA, 170 bp, Homo sapiens
gggccctcaccaactaccaacggctctgcgaggcctttgacgcccaggtggtcagtgggggcacagccacaccatctattcactgccttctggtttagggtcacagagagggacctcaaagggcattaggtcaaaatcctggtgggacaagaggggaaactgaggctggt

SEQ ID NO: 3589 - DNA, 170 bp, Homo sapiens
ccatcccccatggcccatgtgccccacagagatacatcttcttcaagacaccgagggaggtgaagcctcccgaggacctgcaagacctgggggtacgcttcctgcagcccttcgtgaatctgctgtccaaaggcacctactggtggatgaacgccttcatcaagactgcc

SEQ ID NO: 3590 - DNA, 170 bp, Homo sapiens
ggtagggagtggtgagaagttggacttacccatcccccatggcccatgtgccccacagagatacatcttcttcaagacaccgagggaggtgaagcctcccgaggacctgcaagacctgggggtacgcttcctgcagcccttcgtgaatctgctgtccaaaggcacctact

SEQ ID NO: 3591 - DNA, 170 bp, Homo sapiens
caaccccagatccttgctggggcaaggtagggagtggtgagaagttggacttacccatcccccatggcccatgtgccccacagagatacatcttcttcaagacaccgagggaggtgaagcctcccgaggacctgcaagacctgggggtacgcttcctgcagcccttcgtg

SEQ ID NO: 3592 - DNA, 170 bp, Homo sapiens
tgttagagatcaagtgtggaatatcacaaccccagatccttgctggggcaaggtagggagtggtgagaagttggacttacccatcccccatggcccatgtgccccacagagatacatcttcttcaagacaccgagggaggtgaagcctcccgaggacctgcaagacctgg

SEQ ID NO: 3593 - DNA, 170 bp, Homo sapiens
acaggcgaaagatggccccatctgttagagatcaagtgtggaatatcacaaccccagatccttgctggggcaaggtagggagtggtgagaagttggacttacccatcccccatggcccatgtgccccacagagatacatcttcttcaagacaccgagggaggtgaagcct

SEQ ID NO: 3594 - DNA, 170 bp, Homo sapiens
agccatcgggaagctgcccatcgccatgagggccctcaccaactaccaacggctctgcgaggcctttgacgcccaggtggtcagtgggggcacagccacaccatctattcactgccttctggtttagggtcacagagagggacctcaaagggcattaggtcaaaatcctg

SEQ ID NO: 3595 - DNA, 170 bp, Homo sapiens
acaagaagcccatcgacttgcgagccatcgggaagctgcccatcgccatgagggccctcaccaactaccaacggctctgcgaggcctttgacgcccaggtggtcagtgggggcacagccacaccatctattcactgccttctggtttagggtcacagagagggacctcaa

SEQ ID NO: 3596 - DNA, 170 bp, Homo sapiens
tgaacgccttcatcaagactgcccacaagaagcccatcgacttgcgagccatcgggaagctgcccatcgccatgagggccctcaccaactaccaacggctctgcgaggcctttgacgcccaggtggtcagtgggggcacagccacaccatctattcactgccttctggtt

SEQ ID NO: 3597 - DNA, 170 bp, Homo sapiens
gtccaaaggcacctactggtggatgaacgccttcatcaagactgcccacaagaagcccatcgacttgcgagccatcgggaagctgcccatcgccatgagggccctcaccaactaccaacggctctgcgaggcctttgacgcccaggtggtcagtgggggcacagccacac

SEQ ID NO: 3598 - DNA, 170 bp, Homo sapiens
gcttcctgcagcccttcgtgaatctgctgtccaaaggcacctactggtggatgaacgccttcatcaagactgcccacaagaagcccatcgacttgcgagccatcgggaagctgcccatcgccatgagggccctcaccaactaccaacggctctgcgaggcctttgacgcc

SEQ ID NO: 3599 - DNA, 170 bp, Homo sapiens
aggacctgcaagacctgggggtacgcttcctgcagcccttcgtgaatctgctgtccaaaggcacctactggtggatgaacgccttcatcaagactgcccacaagaagcccatcgacttgcgagccatcgggaagctgcccatcgccatgagggccctcaccaactaccaa

SEQ ID NO: 3600 - DNA, 170 bp, Homo sapiens
gacaccgagggaggtgaagcctcccgaggacctgcaagacctgggggtacgcttcctgcagcccttcgtgaatctgctgtccaaaggcacctactggtggatgaacgccttcatcaagactgcccacaagaagcccatcgacttgcgagccatcgggaagctgcccatcg

SEQ ID NO: 3601 - DNA, 170 bp, Homo sapiens
gccccacagagatacatcttcttcaagacaccgagggaggtgaagcctcccgaggacctgcaagacctgggggtacgcttcctgcagcccttcgtgaatctgctgtccaaaggcacctactggtggatgaacgccttcatcaagactgcccacaagaagcccatcgactt

SEQ ID NO: 3602 - DNA, 170 bp, Homo sapiens
acgacgtcttccagcccaaggtaggcagccccaggggtagggtaaggcaccctctagatggttttcagttgtttctgagagtgcaacaggccaatgtgtgtgagccatggccacactggagtggctcctcacacatgcgcaaagcccatagcagtatccccaccacagaa

SEQ ID NO: 3603 - DNA, 170 bp, Homo sapiens
tcgtggaccaccttgggaaggagaacgacgtcttccagcccaaggtaggcagccccaggggtagggtaaggcaccctctagatggttttcagttgtttctgagagtgcaacaggccaatgtgtgtgagccatggccacactggagtggctcctcacacatgcgcaaagcc

SEQ ID NO: 3604 - DNA, 170 bp, Homo sapiens
gagctaggggcatcctgggaggctaggcccagccgtgaattagccctcaggcactctgacctggccatggtctctctgggcagcggaaggacattcagggcactcaaggtgcccgggccatctggcaggcactcagccatgccttcgggaggcgcctggtcctcagcagc

SEQ ID NO: 3605 - DNA, 170 bp, Homo sapiens
actgggtttccccagacaacaggagctaggggcatcctgggaggctaggcccagccgtgaattagccctcaggcactctgacctggccatggtctctctgggcagcggaaggacattcagggcactcaaggtgcccgggccatctggcaggcactcagccatgccttcgg

SEQ ID NO: 3606 - DNA, 170 bp, Homo sapiens
ggagttcacctatttgcagaggatgtgaccactgggtttccccagacaacaggagctaggggcatcctgggaggctaggcccagccgtgaattagccctcaggcactctgacctggccatggtctctctgggcagcggaaggacattcagggcactcaaggtgcccgggc

SEQ ID NO: 3607 - DNA, 170 bp, Homo sapiens
ccgggccactgtgcatctttgggatcgtggaccaccttgggaaggagaacgacgtcttccagcccaaggtaggcagccccaggggtagggtaaggcaccctctagatggttttcagttgtttctgagagtgcaacaggccaatgtgtgtgagccatggccacactggagt

SEQ ID NO: 3608 - DNA, 170 bp, Homo sapiens
catcttggccgacctgctgggcttcgccgggccactgtgcatctttgggatcgtggaccaccttgggaaggagaacgacgtcttccagcccaaggtaggcagccccaggggtagggtaaggcaccctctagatggttttcagttgtttctgagagtgcaacaggccaatg

SEQ ID NO: 3609 - DNA, 170 bp, Homo sapiens
cctggtcctcagcagcactttccgcatcttggccgacctgctgggcttcgccgggccactgtgcatctttgggatcgtggaccaccttgggaaggagaacgacgtcttccagcccaaggtaggcagccccaggggtagggtaaggcaccctctagatggttttcagttgt

SEQ ID NO: 3610 - DNA, 170 bp, Homo sapiens
ggcactcagccatgccttcgggaggcgcctggtcctcagcagcactttccgcatcttggccgacctgctgggcttcgccgggccactgtgcatctttgggatcgtggaccaccttgggaaggagaacgacgtcttccagcccaaggtaggcagccccaggggtagggtaa

SEQ ID NO: 3611 - DNA, 170 bp, Homo sapiens
aaggtgcccgggccatctggcaggcactcagccatgccttcgggaggcgcctggtcctcagcagcactttccgcatcttggccgacctgctgggcttcgccgggccactgtgcatctttgggatcgtggaccaccttgggaaggagaacgacgtcttccagcccaaggta

SEQ ID NO: 3612 - DNA, 170 bp, Homo sapiens
gggcagcggaaggacattcagggcactcaaggtgcccgggccatctggcaggcactcagccatgccttcgggaggcgcctggtcctcagcagcactttccgcatcttggccgacctgctgggcttcgccgggccactgtgcatctttgggatcgtggaccaccttgggaa

SEQ ID NO: 3613 - DNA, 170 bp, Homo sapiens
cactctgacctggccatggtctctctgggcagcggaaggacattcagggcactcaaggtgcccgggccatctggcaggcactcagccatgccttcgggaggcgcctggtcctcagcagcactttccgcatcttggccgacctgctgggcttcgccgggccactgtgcatc

SEQ ID NO: 3614 - DNA, 170 bp, Homo sapiens
aggcccagccgtgaattagccctcaggcactctgacctggccatggtctctctgggcagcggaaggacattcagggcactcaaggtgcccgggccatctggcaggcactcagccatgccttcgggaggcgcctggtcctcagcagcactttccgcatcttggccgacctg

SEQ ID NO: 3615 - DNA, 170 bp, Homo sapiens
ttgaaactggaattaacttgagaggagcaatacaggtacttggatgattattttttcactttgccataagaaccattattaggaataatgtccatgagtgttattcatcctcatggacactcaagaataattctgctgtaaatttattttttgttgcccattaacgatgt

SEQ ID NO: 3616 - DNA, 170 bp, Homo sapiens
gcaagcatcctactatgtggccattgaaactggaattaacttgagaggagcaatacaggtacttggatgattattttttcactttgccataagaaccattattaggaataatgtccatgagtgttattcatcctcatggacactcaagaataattctgctgtaaatttat

SEQ ID NO: 3617 - DNA, 170 bp, Homo sapiens
caagcccagagggtcttgtaataatgatggccgtggtccattatggcacagtgatgtgttctacggtggtcattttgctggcaatgacagtcacctctgaacttctctttccaacagacacaatttctcggggtttactttgtctcatcccaagagttccttgccaatgc

SEQ ID NO: 3618 - DNA, 170 bp, Homo sapiens
actcataaacaattgcacaagcctttgcaagcccagagggtcttgtaataatgatggccgtggtccattatggcacagtgatgtgttctacggtggtcattttgctggcaatgacagtcacctctgaacttctctttccaacagacacaatttctcggggtttactttgt

SEQ ID NO: 3619 - DNA, 170 bp, Homo sapiens
cctcctactgcaaaggacatttctgcaagcatcctactatgtggccattgaaactggaattaacttgagaggagcaatacaggtacttggatgattattttttcactttgccataagaaccattattaggaataatgtccatgagtgttattcatcctcatggacactca

SEQ ID NO: 3620 - DNA, 170 bp, Homo sapiens
cttagctgtgcttctgttccttgccctcctactgcaaaggacatttctgcaagcatcctactatgtggccattgaaactggaattaacttgagaggagcaatacaggtacttggatgattattttttcactttgccataagaaccattattaggaataatgtccatgagt

SEQ ID NO: 3621 - DNA, 170 bp, Homo sapiens
cccaagagttccttgccaatgcctacgtcttagctgtgcttctgttccttgccctcctactgcaaaggacatttctgcaagcatcctactatgtggccattgaaactggaattaacttgagaggagcaatacaggtacttggatgattattttttcactttgccataaga

SEQ ID NO: 3622 - DNA, 170 bp, Homo sapiens
ttctcggggtttactttgtctcatcccaagagttccttgccaatgcctacgtcttagctgtgcttctgttccttgccctcctactgcaaaggacatttctgcaagcatcctactatgtggccattgaaactggaattaacttgagaggagcaatacaggtacttggatga

SEQ ID NO: 3623 - DNA, 170 bp, Homo sapiens
cctctgaacttctctttccaacagacacaatttctcggggtttactttgtctcatcccaagagttccttgccaatgcctacgtcttagctgtgcttctgttccttgccctcctactgcaaaggacatttctgcaagcatcctactatgtggccattgaaactggaattaa

SEQ ID NO: 3624 - DNA, 170 bp, Homo sapiens
tgctggcaatgacagtcacctctgaacttctctttccaacagacacaatttctcggggtttactttgtctcatcccaagagttccttgccaatgcctacgtcttagctgtgcttctgttccttgccctcctactgcaaaggacatttctgcaagcatcctactatgtggc

SEQ ID NO: 3625 - DNA, 170 bp, Homo sapiens
acagtgatgtgttctacggtggtcattttgctggcaatgacagtcacctctgaacttctctttccaacagacacaatttctcggggtttactttgtctcatcccaagagttccttgccaatgcctacgtcttagctgtgcttctgttccttgccctcctactgcaaagga

SEQ ID NO: 3626 - DNA, 170 bp, Homo sapiens
atggccgtggtccattatggcacagtgatgtgttctacggtggtcattttgctggcaatgacagtcacctctgaacttctctttccaacagacacaatttctcggggtttactttgtctcatcccaagagttccttgccaatgcctacgtcttagctgtgcttctgttcc

SEQ ID NO: 3627 - DNA, 170 bp, Homo sapiens
ttcttcttgtgcccaaacctctgggctatgccagtacaggtactagatgggctgaggggaagggaggggggcagcaggacacacaaccagaatctgctggtccatggccagtaactaggagcacaccgtcttccactccatgcttgcctgtacctttcacacacttggct

SEQ ID NO: 3628 - DNA, 170 bp, Homo sapiens
acaccaatcagctcatgtggtttttcttcttgtgcccaaacctctgggctatgccagtacaggtactagatgggctgaggggaagggaggggggcagcaggacacacaaccagaatctgctggtccatggccagtaactaggagcacaccgtcttccactccatgcttgc

SEQ ID NO: 3629 - DNA, 170 bp, Homo sapiens
ccttacagagctgctctagggcaccatggggactgtctgagaagcccctggcacactgtaacaggtggcatctggtgtggtgatgatgatgagaatgatgatgaatgtgaaacactctgctctcatttctagaccaagatttacaataaaattatgcacctgtccacctc

SEQ ID NO: 3630 - DNA, 170 bp, Homo sapiens
ggacagatctgtaatctggttgccatcgacaccaatcagctcatgtggtttttcttcttgtgcccaaacctctgggctatgccagtacaggtactagatgggctgaggggaagggaggggggcagcaggacacacaaccagaatctgctggtccatggccagtaactagg

SEQ ID NO: 3631 - DNA, 170 bp, Homo sapiens
gtccatgggagaaatgactgctggacagatctgtaatctggttgccatcgacaccaatcagctcatgtggtttttcttcttgtgcccaaacctctgggctatgccagtacaggtactagatgggctgaggggaagggaggggggcagcaggacacacaaccagaatctgc

SEQ ID NO: 3632 - DNA, 170 bp, Homo sapiens
ataaaattatgcacctgtccacctccaacctgtccatgggagaaatgactgctggacagatctgtaatctggttgccatcgacaccaatcagctcatgtggtttttcttcttgtgcccaaacctctgggctatgccagtacaggtactagatgggctgaggggaagggag

SEQ ID NO: 3633 - DNA, 170 bp, Homo sapiens
catttctagaccaagatttacaataaaattatgcacctgtccacctccaacctgtccatgggagaaatgactgctggacagatctgtaatctggttgccatcgacaccaatcagctcatgtggtttttcttcttgtgcccaaacctctgggctatgccagtacaggtact

SEQ ID NO: 3634 - DNA, 170 bp, Homo sapiens
tgaatgtgaaacactctgctctcatttctagaccaagatttacaataaaattatgcacctgtccacctccaacctgtccatgggagaaatgactgctggacagatctgtaatctggttgccatcgacaccaatcagctcatgtggtttttcttcttgtgcccaaacctct

SEQ ID NO: 3635 - DNA, 170 bp, Homo sapiens
tgtggtgatgatgatgagaatgatgatgaatgtgaaacactctgctctcatttctagaccaagatttacaataaaattatgcacctgtccacctccaacctgtccatgggagaaatgactgctggacagatctgtaatctggttgccatcgacaccaatcagctcatgtg

SEQ ID NO: 3636 - DNA, 170 bp, Homo sapiens
acactgtaacaggtggcatctggtgtggtgatgatgatgagaatgatgatgaatgtgaaacactctgctctcatttctagaccaagatttacaataaaattatgcacctgtccacctccaacctgtccatgggagaaatgactgctggacagatctgtaatctggttgcc

SEQ ID NO: 3637 - DNA, 170 bp, Homo sapiens
ggggactgtctgagaagcccctggcacactgtaacaggtggcatctggtgtggtgatgatgatgagaatgatgatgaatgtgaaacactctgctctcatttctagaccaagatttacaataaaattatgcacctgtccacctccaacctgtccatgggagaaatgactgc

SEQ ID NO: 3638 - DNA, 170 bp, Homo sapiens
aggcccagcggagcacactggtgagtgcccaaaggtgtgtgtgttttgtccctcttcccctccttccctcgacagcagcaggtctcctcccacacacccacactgtcattgactttgactttgactttgagtaggccacttcacctgtccaggcctcagcttctttgtct

SEQ ID NO: 3639 - DNA, 170 bp, Homo sapiens
ttcgtggccaccaagctgtctcaggcccagcggagcacactggtgagtgcccaaaggtgtgtgtgttttgtccctcttcccctccttccctcgacagcagcaggtctcctcccacacacccacactgtcattgactttgactttgactttgagtaggccacttcacctgt

SEQ ID NO: 3640 - DNA, 170 bp, Homo sapiens
ccccaagataatttggaaacctgggcaccaaggcttgtcccactctaggggactggggaaacagggattttgccagcacctcctggcagggcaaccatcaggtcaaagggacctgacccatgaccccttcctcagatcattgtgggtgtgattctcctctactacatact

SEQ ID NO: 3641 - DNA, 170 bp, Homo sapiens
catcattctactggctcctgtccagtacttcgtggccaccaagctgtctcaggcccagcggagcacactggtgagtgcccaaaggtgtgtgtgttttgtccctcttcccctccttccctcgacagcagcaggtctcctcccacacacccacactgtcattgactttgact

SEQ ID NO: 3642 - DNA, 170 bp, Homo sapiens
agtcagtgccttaattggagcagctgtcatcattctactggctcctgtccagtacttcgtggccaccaagctgtctcaggcccagcggagcacactggtgagtgcccaaaggtgtgtgtgttttgtccctcttcccctccttccctcgacagcagcaggtctcctcccac

SEQ ID NO: 3643 - DNA, 170 bp, Homo sapiens
gtgattctcctctactacatactcggagtcagtgccttaattggagcagctgtcatcattctactggctcctgtccagtacttcgtggccaccaagctgtctcaggcccagcggagcacactggtgagtgcccaaaggtgtgtgtgttttgtccctcttcccctccttcc

SEQ ID NO: 3644 - DNA, 170 bp, Homo sapiens
ccccttcctcagatcattgtgggtgtgattctcctctactacatactcggagtcagtgccttaattggagcagctgtcatcattctactggctcctgtccagtacttcgtggccaccaagctgtctcaggcccagcggagcacactggtgagtgcccaaaggtgtgtgtg

SEQ ID NO: 3645 - DNA, 170 bp, Homo sapiens
caggtcaaagggacctgacccatgaccccttcctcagatcattgtgggtgtgattctcctctactacatactcggagtcagtgccttaattggagcagctgtcatcattctactggctcctgtccagtacttcgtggccaccaagctgtctcaggcccagcggagcacac

SEQ ID NO: 3646 - DNA, 170 bp, Homo sapiens
acctcctggcagggcaaccatcaggtcaaagggacctgacccatgaccccttcctcagatcattgtgggtgtgattctcctctactacatactcggagtcagtgccttaattggagcagctgtcatcattctactggctcctgtccagtacttcgtggccaccaagctgt

SEQ ID NO: 3647 - DNA, 170 bp, Homo sapiens
actggggaaacagggattttgccagcacctcctggcagggcaaccatcaggtcaaagggacctgacccatgaccccttcctcagatcattgtgggtgtgattctcctctactacatactcggagtcagtgccttaattggagcagctgtcatcattctactggctcctgt

SEQ ID NO: 3648 - DNA, 170 bp, Homo sapiens
ccaaggcttgtcccactctaggggactggggaaacagggattttgccagcacctcctggcagggcaaccatcaggtcaaagggacctgacccatgaccccttcctcagatcattgtgggtgtgattctcctctactacatactcggagtcagtgccttaattggagcagc

SEQ ID NO: 3649 - DNA, 170 bp, Homo sapiens
taaaatatactccactcaagggaattctgtactttgccctttgggtaaagtctcatttacatttctaaacctttcttaagaaaatcgaatttcctttgatctctcttctgaattgcagaaatcagataaaaactacttggtgaaatgacttcttgtcacattgctgaaga

SEQ ID NO: 3650 - DNA, 170 bp, Homo sapiens
tgtactttgccctttgggtaaagtctcatttacatttctaaacctttcttaagaaaatcgaatttcctttgatctctcttctgaattgcagaaatcagataaaaactacttggtgaaatgacttcttgtcacattgctgaagaacatatacaaaaggttgctatctttgg

SEQ ID NO: 3651 - DNA, 170 bp, Homo sapiens
tggcgctgagattcagagaacagggctggaggtaaaaccatttattactaaccccagagcagtgaagaagtgtaccagatatattgactgtgacctgaatcgcatttttgaccttgaaaatcttgggtaagactatgctttgtattgtatatgtatgtatgttgtgtgaa

SEQ ID NO: 3652 - DNA, 170 bp, Homo sapiens
agggctggaggtaaaaccatttattactaaccccagagcagtgaagaagtgtaccagatatattgactgtgacctgaatcgcatttttgaccttgaaaatcttgggtaagactatgctttgtattgtatatgtatgtatgttgtgtgaaaagtggtaggtgtgtgaaaga

SEQ ID NO: 3653 - DNA, 170 bp, Homo sapiens
accccagagcagtgaagaagtgtaccagatatattgactgtgacctgaatcgcatttttgaccttgaaaatcttgggtaagactatgctttgtattgtatatgtatgtatgttgtgtgaaaagtggtaggtgtgtgaaagagaacacatatatgtatatgcagatgataa

SEQ ID NO: 3654 - DNA, 170 bp, Homo sapiens
tgtaccagatatattgactgtgacctgaatcgcatttttgaccttgaaaatcttgggtaagactatgctttgtattgtatatgtatgtatgttgtgtgaaaagtggtaggtgtgtgaaagagaacacatatatgtatatgcagatgataattcatgtccgtacatgcagt

SEQ ID NO: 3655 - DNA, 170 bp, Homo sapiens
tcgcatttttgaccttgaaaatcttgggtaagactatgctttgtattgtatatgtatgtatgttgtgtgaaaagtggtaggtgtgtgaaagagaacacatatatgtatatgcagatgataattcatgtccgtacatgcagtcgtatgttgaataagatcactttcacttt

SEQ ID NO: 3656 - DNA, 170 bp, Homo sapiens
agtctcatttacatttctaaacctttcttaagaaaatcgaatttcctttgatctctcttctgaattgcagaaatcagataaaaactacttggtgaaatgacttcttgtcacattgctgaagaacatatacaaaaggttgctatctttggaggaacccatgggaatgagct

SEQ ID NO: 3657 - DNA, 170 bp, Homo sapiens
aagaaaatcgaatttcctttgatctctcttctgaattgcagaaatcagataaaaactacttggtgaaatgacttcttgtcacattgctgaagaacatatacaaaaggttgctatctttggaggaacccatgggaatgagctaaccggagtatttctggttaagcattggc

SEQ ID NO: 3658 - DNA, 170 bp, Homo sapiens
tctctcttctgaattgcagaaatcagataaaaactacttggtgaaatgacttcttgtcacattgctgaagaacatatacaaaaggttgctatctttggaggaacccatgggaatgagctaaccggagtatttctggttaagcattggctagagaatggcgctgagattca

SEQ ID NO: 3659 - DNA, 170 bp, Homo sapiens
agataaaaactacttggtgaaatgacttcttgtcacattgctgaagaacatatacaaaaggttgctatctttggaggaacccatgggaatgagctaaccggagtatttctggttaagcattggctagagaatggcgctgagattcagagaacagggctggaggtaaaacc

SEQ ID NO: 3660 - DNA, 170 bp, Homo sapiens
ttcttgtcacattgctgaagaacatatacaaaaggttgctatctttggaggaacccatgggaatgagctaaccggagtatttctggttaagcattggctagagaatggcgctgagattcagagaacagggctggaggtaaaaccatttattactaaccccagagcagtga

SEQ ID NO: 3661 - DNA, 170 bp, Homo sapiens
acaaaaggttgctatctttggaggaacccatgggaatgagctaaccggagtatttctggttaagcattggctagagaatggcgctgagattcagagaacagggctggaggtaaaaccatttattactaaccccagagcagtgaagaagtgtaccagatatattgactgtg

SEQ ID NO: 3662 - DNA, 170 bp, Homo sapiens
acccatgggaatgagctaaccggagtatttctggttaagcattggctagagaatggcgctgagattcagagaacagggctggaggtaaaaccatttattactaaccccagagcagtgaagaagtgtaccagatatattgactgtgacctgaatcgcatttttgaccttga

SEQ ID NO: 3663 - DNA, 170 bp, Homo sapiens
agtatttctggttaagcattggctagagaatggcgctgagattcagagaacagggctggaggtaaaaccatttattactaaccccagagcagtgaagaagtgtaccagatatattgactgtgacctgaatcgcatttttgaccttgaaaatcttgggtaagactatgctt

SEQ ID NO: 3664 - DNA, 170 bp, Homo sapiens
aaacatttcaggtaagtttttacttaccacacagatttttcatattaaagatttggcgactggttctttttacactgtgttcttattatatgtttatattatctcaggcacagatgttgttcatctttttctttctgcttataacagcaaaaaaatgtcagaagatttgc

SEQ ID NO: 3665 - DNA, 170 bp, Homo sapiens
acttaccacacagatttttcatattaaagatttggcgactggttctttttacactgtgttcttattatatgtttatattatctcaggcacagatgttgttcatctttttctttctgcttataacagcaaaaaaatgtcagaagatttgccatatgaagtgagaagggctc

SEQ ID NO: 3666 - DNA, 170 bp, Homo sapiens
tgaccttcacaacaccacctctaacatggggtgcactcttattcttgaggattccaggaataactttttaattcagatgtttcattacattaaggtaatgttaatgttattaatttataagttagcaaaggacttgtacttttaagtcaattatggatgtgagacaatca

SEQ ID NO: 3667 - DNA, 170 bp, Homo sapiens
catggggtgcactcttattcttgaggattccaggaataactttttaattcagatgtttcattacattaaggtaatgttaatgttattaatttataagttagcaaaggacttgtacttttaagtcaattatggatgtgagacaatcagaaaacagttatgagggaaggtgc

SEQ ID NO: 3668 - DNA, 170 bp, Homo sapiens
gaggattccaggaataactttttaattcagatgtttcattacattaaggtaatgttaatgttattaatttataagttagcaaaggacttgtacttttaagtcaattatggatgtgagacaatcagaaaacagttatgagggaaggtgcaagagaaatggggtttattcca

SEQ ID NO: 3669 - DNA, 170 bp, Homo sapiens
ttggcgactggttctttttacactgtgttcttattatatgtttatattatctcaggcacagatgttgttcatctttttctttctgcttataacagcaaaaaaatgtcagaagatttgccatatgaagtgagaagggctcaagaaataaatcatttatttggtccaaaaga

SEQ ID NO: 3670 - DNA, 170 bp, Homo sapiens
cactgtgttcttattatatgtttatattatctcaggcacagatgttgttcatctttttctttctgcttataacagcaaaaaaatgtcagaagatttgccatatgaagtgagaagggctcaagaaataaatcatttatttggtccaaaagacagtgaagattcctatgaca

SEQ ID NO: 3671 - DNA, 170 bp, Homo sapiens
ttatctcaggcacagatgttgttcatctttttctttctgcttataacagcaaaaaaatgtcagaagatttgccatatgaagtgagaagggctcaagaaataaatcatttatttggtccaaaagacagtgaagattcctatgacattatttttgaccttcacaacaccacc

SEQ ID NO: 3672 - DNA, 170 bp, Homo sapiens
gttcatctttttctttctgcttataacagcaaaaaaatgtcagaagatttgccatatgaagtgagaagggctcaagaaataaatcatttatttggtccaaaagacagtgaagattcctatgacattatttttgaccttcacaacaccacctctaacatggggtgcactct

SEQ ID NO: 3673 - DNA, 170 bp, Homo sapiens
gcaaaaaaatgtcagaagatttgccatatgaagtgagaagggctcaagaaataaatcatttatttggtccaaaagacagtgaagattcctatgacattatttttgaccttcacaacaccacctctaacatggggtgcactcttattcttgaggattccaggaataacttt

SEQ ID NO: 3674 - DNA, 170 bp, Homo sapiens
gaagtgagaagggctcaagaaataaatcatttatttggtccaaaagacagtgaagattcctatgacattatttttgaccttcacaacaccacctctaacatggggtgcactcttattcttgaggattccaggaataactttttaattcagatgtttcattacattaaggt

SEQ ID NO: 3675 - DNA, 170 bp, Homo sapiens
tcatttatttggtccaaaagacagtgaagattcctatgacattatttttgaccttcacaacaccacctctaacatggggtgcactcttattcttgaggattccaggaataactttttaattcagatgtttcattacattaaggtaatgttaatgttattaatttataagt

SEQ ID NO: 3676 - DNA, 170 bp, Homo sapiens
acagtgaagattcctatgacattatttttgaccttcacaacaccacctctaacatggggtgcactcttattcttgaggattccaggaataactttttaattcagatgtttcattacattaaggtaatgttaatgttattaatttataagttagcaaaggacttgtacttt

SEQ ID NO: 3677 - DNA, 170 bp, Homo sapiens
accattgggttttaaagtatttcataaagctgtcttaccaatcttagttgatgaagtaaaacgtattgaaggtattattgactctgttgaagcaaagagaacaaaacatacggtttttacctaagaaagacgtttttgatttttttcagacttctctggctccactaccc

SEQ ID NO: 3678 - DNA, 170 bp, Homo sapiens
agctgtcttaccaatcttagttgatgaagtaaaacgtattgaaggtattattgactctgttgaagcaaagagaacaaaacatacggtttttacctaagaaagacgtttttgatttttttcagacttctctggctccactaccctgctacgtttatctgattgagcatcct

SEQ ID NO: 3679 - DNA, 170 bp, Homo sapiens
tgaagtaaaacgtattgaaggtattattgactctgttgaagcaaagagaacaaaacatacggtttttacctaagaaagacgtttttgatttttttcagacttctctggctccactaccctgctacgtttatctgattgagcatccttccctcaaatatgcgaccactcgt

SEQ ID NO: 3680 - DNA, 170 bp, Homo sapiens
ttgactctgttgaagcaaagagaacaaaacatacggtttttacctaagaaagacgtttttgatttttttcagacttctctggctccactaccctgctacgtttatctgattgagcatccttccctcaaatatgcgaccactcgttccatagccaagtatcctgtgggtaa

SEQ ID NO: 3681 - DNA, 170 bp, Homo sapiens
acaaaacatacggtttttacctaagaaagacgtttttgatttttttcagacttctctggctccactaccctgctacgtttatctgattgagcatccttccctcaaatatgcgaccactcgttccatagccaagtatcctgtgggtaagtcatagttcccactgtcataac

SEQ ID NO: 3682 - DNA, 170 bp, Homo sapiens
agacgtttttgatttttttcagacttctctggctccactaccctgctacgtttatctgattgagcatccttccctcaaatatgcgaccactcgttccatagccaagtatcctgtgggtaagtcatagttcccactgtcataactcaataaaatatgtcctagctgaaact

SEQ ID NO: 3683 - DNA, 170 bp, Homo sapiens
tggctccactaccctgctacgtttatctgattgagcatccttccctcaaatatgcgaccactcgttccatagccaagtatcctgtgggtaagtcatagttcccactgtcataactcaataaaatatgtcctagctgaaactcagagaaatttattttttatcttatttta

SEQ ID NO: 3684 - DNA, 170 bp, Homo sapiens
tttatctgattgagcatccttccctcaaatatgcgaccactcgttccatagccaagtatcctgtgggtaagtcatagttcccactgtcataactcaataaaatatgtcctagctgaaactcagagaaatttattttttatcttattttatttttgagacagagtcttgct

SEQ ID NO: 3685 - DNA, 170 bp, Homo sapiens
cctcaaatatgcgaccactcgttccatagccaagtatcctgtgggtaagtcatagttcccactgtcataactcaataaaatatgtcctagctgaaactcagagaaatttattttttatcttattttatttttgagacagagtcttgctctgtcacccaggctggagtccg

SEQ ID NO: 3686 - DNA, 170 bp, Homo sapiens
tgtctcaaatattttccatgatgctacatggtttacctttttaataattttaacaacataattctaaatcttgatacattaaaatgcttagttttataatatattttcatacttatataaatgtgactatctctccttctgtacctaggtatagaagttggtcctcagcc

SEQ ID NO: 3687 - DNA, 170 bp, Homo sapiens
catggtttacctttttaataattttaacaacataattctaaatcttgatacattaaaatgcttagttttataatatattttcatacttatataaatgtgactatctctccttctgtacctaggtatagaagttggtcctcagcctcaaggggttctgagagctgatatct

SEQ ID NO: 3688 - DNA, 170 bp, Homo sapiens
caacataattctaaatcttgatacattaaaatgcttagttttataatatattttcatacttatataaatgtgactatctctccttctgtacctaggtatagaagttggtcctcagcctcaaggggttctgagagctgatatcttggatcaaatgagaaaaatgattaaac

SEQ ID NO: 3689 - DNA, 170 bp, Homo sapiens
atgcttagttttataatatattttcatacttatataaatgtgactatctctccttctgtacctaggtatagaagttggtcctcagcctcaaggggttctgagagctgatatcttggatcaaatgagaaaaatgattaaacatgctcttgattttatacatcatttcaatg

SEQ ID NO: 3690 - DNA, 170 bp, Homo sapiens
ttttcatacttatataaatgtgactatctctccttctgtacctaggtatagaagttggtcctcagcctcaaggggttctgagagctgatatcttggatcaaatgagaaaaatgattaaacatgctcttgattttatacatcatttcaatgaaggtaagtaataatgaagg

SEQ ID NO: 3691 - DNA, 170 bp, Homo sapiens
tctctccttctgtacctaggtatagaagttggtcctcagcctcaaggggttctgagagctgatatcttggatcaaatgagaaaaatgattaaacatgctcttgattttatacatcatttcaatgaaggtaagtaataatgaaggtaacgttatcaaacttaaccaccaaa

SEQ ID NO: 3692 - DNA, 170 bp, Homo sapiens
agttggtcctcagcctcaaggggttctgagagctgatatcttggatcaaatgagaaaaatgattaaacatgctcttgattttatacatcatttcaatgaaggtaagtaataatgaaggtaacgttatcaaacttaaccaccaaacatttaaataacaattggaacctggg

SEQ ID NO: 3693 - DNA, 170 bp, Homo sapiens
ggttctgagagctgatatcttggatcaaatgagaaaaatgattaaacatgctcttgattttatacatcatttcaatgaaggtaagtaataatgaaggtaacgttatcaaacttaaccaccaaacatttaaataacaattggaacctgggtcagatttgccatgctaaaga

SEQ ID NO: 3694 - DNA, 170 bp, Homo sapiens
tgagaaaaatgattaaacatgctcttgattttatacatcatttcaatgaaggtaagtaataatgaaggtaacgttatcaaacttaaccaccaaacatttaaataacaattggaacctgggtcagatttgccatgctaaagatatgaagtgctttttaaaatttttattca

SEQ ID NO: 3695 - DNA, 170 bp, Homo sapiens
gctcttgattttatacatcatttcaatgaaggtaagtaataatgaaggtaacgttatcaaacttaaccaccaaacatttaaataacaattggaacctgggtcagatttgccatgctaaagatatgaagtgctttttaaaatttttattcacttcagctattccccaatgg

SEQ ID NO: 3696 - DNA, 170 bp, Homo sapiens
tggccaggctgttctcgaactcctgacctcaggtgatccacccaactcggcctcccaaagtgctgggatgacaggcatgagccaccacacccggcccagagatgtttttagttgccattgatacatattgtttttgtcataggaaaagaatttcctccctgcgccattga

SEQ ID NO: 3697 - DNA, 170 bp, Homo sapiens
ctcaggtgatccacccaactcggcctcccaaagtgctgggatgacaggcatgagccaccacacccggcccagagatgtttttagttgccattgatacatattgtttttgtcataggaaaagaatttcctccctgcgccattgaggtctataaaattatagagaaagttga

SEQ ID NO: 3698 - DNA, 170 bp, Homo sapiens
cctcccaaagtgctgggatgacaggcatgagccaccacacccggcccagagatgtttttagttgccattgatacatattgtttttgtcataggaaaagaatttcctccctgcgccattgaggtctataaaattatagagaaagttgattacccccgggatgaaaatggag

SEQ ID NO: 3699 - DNA, 170 bp, Homo sapiens
gccaccacacccggcccagagatgtttttagttgccattgatacatattgtttttgtcataggaaaagaatttcctccctgcgccattgaggtctataaaattatagagaaagttgattacccccgggatgaaaatggagaaattgctgctatcatccatcctaatctgc

SEQ ID NO: 3700 - DNA, 170 bp, Homo sapiens
tgtttttagttgccattgatacatattgtttttgtcataggaaaagaatttcctccctgcgccattgaggtctataaaattatagagaaagttgattacccccgggatgaaaatggagaaattgctgctatcatccatcctaatctgcaggtaacatttgttctttcttt

SEQ ID NO: 3701 - DNA, 170 bp, Homo sapiens
ttgtttttgtcataggaaaagaatttcctccctgcgccattgaggtctataaaattatagagaaagttgattacccccgggatgaaaatggagaaattgctgctatcatccatcctaatctgcaggtaacatttgttctttctttaaaatgttgaaaataataatgctgt

SEQ ID NO: 3702 - DNA, 170 bp, Homo sapiens
cctccctgcgccattgaggtctataaaattatagagaaagttgattacccccgggatgaaaatggagaaattgctgctatcatccatcctaatctgcaggtaacatttgttctttctttaaaatgttgaaaataataatgctgtacctttgaatagaagtttatagctca

SEQ ID NO: 3703 - DNA, 170 bp, Homo sapiens
gtctataaaattatagagaaagttgattacccccgggatgaaaatggagaaattgctgctatcatccatcctaatctgcaggtaacatttgttctttctttaaaatgttgaaaataataatgctgtacctttgaatagaagtttatagctcatacagcacttcgcgtaca

SEQ ID NO: 3704 - DNA, 170 bp, Homo sapiens
ccccgggatgaaaatggagaaattgctgctatcatccatcctaatctgcaggtaacatttgttctttctttaaaatgttgaaaataataatgctgtacctttgaatagaagtttatagctcatacagcacttcgcgtacattcgcccatttgatgctctcattagacact

SEQ ID NO: 3705 - DNA, 170 bp, Homo sapiens
ttgctgctatcatccatcctaatctgcaggtaacatttgttctttctttaaaatgttgaaaataataatgctgtacctttgaatagaagtttatagctcatacagcacttcgcgtacattcgcccatttgatgctctcattagacactgagtgtagatagggaagatgtt

SEQ ID NO: 3706 - DNA, 170 bp, Homo sapiens
gcctgcatctcaatgcctcgctcaagtatctcttttaaaacaacagaatactgtaatttgttagttgtctagagtctgacataaatttttagaggagaaaaaccaaatataatatatttattttgattgtttcctgagaggatcaagactggaaaccactgcatcctggg

SEQ ID NO: 3707 - DNA, 170 bp, Homo sapiens
aagtatctcttttaaaacaacagaatactgtaatttgttagttgtctagagtctgacataaatttttagaggagaaaaaccaaatataatatatttattttgattgtttcctgagaggatcaagactggaaaccactgcatcctggggatcccatgtttttaactcttga

SEQ ID NO: 3708 - DNA, 170 bp, Homo sapiens
ggccgcatattacgaaaagaaagaagcttttgcaaagacaactaaactaacgctcaatgcaaaaagtattcgctgctgtttacattagaaatcacttccagcttacatcttacacggtgtcttacaaattctgctagtctgtaagctccttaagagtagggttgtgcctt

SEQ ID NO: 3709 - DNA, 170 bp, Homo sapiens
aagcttttgcaaagacaactaaactaacgctcaatgcaaaaagtattcgctgctgtttacattagaaatcacttccagcttacatcttacacggtgtcttacaaattctgctagtctgtaagctccttaagagtagggttgtgccttattcaactgcatacatagctcct

SEQ ID NO: 3710 - DNA, 170 bp, Homo sapiens
aacgctcaatgcaaaaagtattcgctgctgtttacattagaaatcacttccagcttacatcttacacggtgtcttacaaattctgctagtctgtaagctccttaagagtagggttgtgccttattcaactgcatacatagctcctagcacagtgccttattcggtaggca

SEQ ID NO: 3711 - DNA, 170 bp, Homo sapiens
aatactgtaatttgttagttgtctagagtctgacataaatttttagaggagaaaaaccaaatataatatatttattttgattgtttcctgagaggatcaagactggaaaccactgcatcctggggatcccatgtttttaactcttgatgggaagacgatcccactgggcg

SEQ ID NO: 3712 - DNA, 170 bp, Homo sapiens
agagtctgacataaatttttagaggagaaaaaccaaatataatatatttattttgattgtttcctgagaggatcaagactggaaaccactgcatcctggggatcccatgtttttaactcttgatgggaagacgatcccactgggcggagactgtaccgtgtaccccgtgt

SEQ ID NO: 3713 - DNA, 170 bp, Homo sapiens
agaaaaaccaaatataatatatttattttgattgtttcctgagaggatcaagactggaaaccactgcatcctggggatcccatgtttttaactcttgatgggaagacgatcccactgggcggagactgtaccgtgtaccccgtgtttgtgaatgaggccgcatattacga

SEQ ID NO: 3714 - DNA, 170 bp, Homo sapiens
tgattgtttcctgagaggatcaagactggaaaccactgcatcctggggatcccatgtttttaactcttgatgggaagacgatcccactgggcggagactgtaccgtgtaccccgtgtttgtgaatgaggccgcatattacgaaaagaaagaagcttttgcaaagacaact

SEQ ID NO: 3715 - DNA, 170 bp, Homo sapiens
aaccactgcatcctggggatcccatgtttttaactcttgatgggaagacgatcccactgggcggagactgtaccgtgtaccccgtgtttgtgaatgaggccgcatattacgaaaagaaagaagcttttgcaaagacaactaaactaacgctcaatgcaaaaagtattcgc

SEQ ID NO: 3716 - DNA, 170 bp, Homo sapiens
gatcccatgtttttaactcttgatgggaagacgatcccactgggcggagactgtaccgtgtaccccgtgtttgtgaatgaggccgcatattacgaaaagaaagaagcttttgcaaagacaactaaactaacgctcaatgcaaaaagtattcgctgctgtttacattagaa

SEQ ID NO: 3717 - DNA, 170 bp, Homo sapiens
cgatcccactgggcggagactgtaccgtgtaccccgtgtttgtgaatgaggccgcatattacgaaaagaaagaagcttttgcaaagacaactaaactaacgctcaatgcaaaaagtattcgctgctgtttacattagaaatcacttccagcttacatcttacacggtgtc

SEQ ID NO: 3718 - DNA, 170 bp, Homo sapiens
cgtgtaccccgtgtttgtgaatgaggccgcatattacgaaaagaaagaagcttttgcaaagacaactaaactaacgctcaatgcaaaaagtattcgctgctgtttacattagaaatcacttccagcttacatcttacacggtgtcttacaaattctgctagtctgtaagc

SEQ ID NO: 3719 - DNA, 170 bp, Homo sapiens
ctctgtgcattctatctaccacagaacgggaagaagatggttttcttgtcagatggtgctggagtttgcgtcaggcacataaagaggcagccccgaatctagcctacgtgagtgccggaccgctgagtggttgttagccaagatggcggtagcgatcgctgcagcgaggg

SEQ ID NO: 3720 - DNA, 170 bp, Homo sapiens
gggaagaagatggttttcttgtcagatggtgctggagtttgcgtcaggcacataaagaggcagccccgaatctagcctacgtgagtgccggaccgctgagtggttgttagccaagatggcggtagcgatcgctgcagcgagggtctggcggctaaaccgtggtttgagcc

SEQ ID NO: 3721 - DNA, 170 bp, Homo sapiens
atggtgctggagtttgcgtcaggcacataaagaggcagccccgaatctagcctacgtgagtgccggaccgctgagtggttgttagccaagatggcggtagcgatcgctgcagcgagggtctggcggctaaaccgtggtttgagccaggctgccctcctgctgctgcggca

SEQ ID NO: 3722 - DNA, 170 bp, Homo sapiens
ggcagccccgaatctagcctacgtgagtgccggaccgctgagtggttgttagccaagatggcggtagcgatcgctgcagcgagggtctggcggctaaaccgtggtttgagccaggctgccctcctgctgctgcggcagcctggggctcggggactggctagatctgtgag

SEQ ID NO: 3723 - DNA, 170 bp, Homo sapiens
gagtgccggaccgctgagtggttgttagccaagatggcggtagcgatcgctgcagcgagggtctggcggctaaaccgtggtttgagccaggctgccctcctgctgctgcggcagcctggggctcggggactggctagatctgtgagtacctgggccccaggcggttttcc

SEQ ID NO: 3724 - DNA, 170 bp, Homo sapiens
tgttagccaagatggcggtagcgatcgctgcagcgagggtctggcggctaaaccgtggtttgagccaggctgccctcctgctgctgcggcagcctggggctcggggactggctagatctgtgagtacctgggccccaggcggttttcccaaaggggattagggatgtaaa

SEQ ID NO: 3725 - DNA, 170 bp, Homo sapiens
gctgcagcgagggtctggcggctaaaccgtggtttgagccaggctgccctcctgctgctgcggcagcctggggctcggggactggctagatctgtgagtacctgggccccaggcggttttcccaaaggggattagggatgtaaaggctatcttcagagtgtggggtccct

SEQ ID NO: 3726 - DNA, 170 bp, Homo sapiens
accgtggtttgagccaggctgccctcctgctgctgcggcagcctggggctcggggactggctagatctgtgagtacctgggccccaggcggttttcccaaaggggattagggatgtaaaggctatcttcagagtgtggggtccctgaaggatatgaaggaagggctgtca

SEQ ID NO: 3727 - DNA, 170 bp, Homo sapiens
tgctgctgcggcagcctggggctcggggactggctagatctgtgagtacctgggccccaggcggttttcccaaaggggattagggatgtaaaggctatcttcagagtgtggggtccctgaaggatatgaaggaagggctgtcacaaaagggaaaaagagtgggagactcc

SEQ ID NO: 3728 - DNA, 170 bp, Homo sapiens
ggctcagaccctgtgagtcaggccccagagttcactggggccacatgctcaaccaccatgccgcctgcctgccgccggggctgagccagcggaaacctgggtgctgcttctgatgcaggtggtctcctctgctctcttccccagcacccccccaggcagcagcagcagtt

SEQ ID NO: 3729 - DNA, 170 bp, Homo sapiens
agagttcactggggccacatgctcaaccaccatgccgcctgcctgccgccggggctgagccagcggaaacctgggtgctgcttctgatgcaggtggtctcctctgctctcttccccagcacccccccaggcagcagcagcagttttcatctctggatgacaagccccagt

SEQ ID NO: 3730 - DNA, 170 bp, Homo sapiens
tcatctctggaatccccatctaccgcgtcatggaccggcaaggccagatcatcaaccccagcgaggacccccacgtgagaggcggcctcccccacttcccgtgccccccacgcccaggccccttgcctgtctcctctctggtcccaactgccccacgtctatctgtgcct

SEQ ID NO: 3731 - DNA, 170 bp, Homo sapiens
tggaccggcaaggccagatcatcaaccccagcgaggacccccacgtgagaggcggcctcccccacttcccgtgccccccacgcccaggccccttgcctgtctcctctctggtcccaactgccccacgtctatctgtgcctccacccgcagctgccgaaggagaaggtgct

SEQ ID NO: 3732 - DNA, 170 bp, Homo sapiens
accccagcgaggacccccacgtgagaggcggcctcccccacttcccgtgccccccacgcccaggccccttgcctgtctcctctctggtcccaactgccccacgtctatctgtgcctccacccgcagctgccgaaggagaaggtgctgaagctctacaagagcatgacact

SEQ ID NO: 3733 - DNA, 170 bp, Homo sapiens
caccatgccgcctgcctgccgccggggctgagccagcggaaacctgggtgctgcttctgatgcaggtggtctcctctgctctcttccccagcacccccccaggcagcagcagcagttttcatctctggatgacaagccccagttcccaggggcctcggcggagtttatag

SEQ ID NO: 3734 - DNA, 170 bp, Homo sapiens
ggctgagccagcggaaacctgggtgctgcttctgatgcaggtggtctcctctgctctcttccccagcacccccccaggcagcagcagcagttttcatctctggatgacaagccccagttcccaggggcctcggcggagtttatagataagttggaattcatccagcccaa

SEQ ID NO: 3735 - DNA, 170 bp, Homo sapiens
tgcttctgatgcaggtggtctcctctgctctcttccccagcacccccccaggcagcagcagcagttttcatctctggatgacaagccccagttcccaggggcctcggcggagtttatagataagttggaattcatccagcccaacgtcatctctggaatccccatctacc

SEQ ID NO: 3736 - DNA, 170 bp, Homo sapiens
cctctgctctcttccccagcacccccccaggcagcagcagcagttttcatctctggatgacaagccccagttcccaggggcctcggcggagtttatagataagttggaattcatccagcccaacgtcatctctggaatccccatctaccgcgtcatggaccggcaaggcc

SEQ ID NO: 3737 - DNA, 170 bp, Homo sapiens
caggcagcagcagcagttttcatctctggatgacaagccccagttcccaggggcctcggcggagtttatagataagttggaattcatccagcccaacgtcatctctggaatccccatctaccgcgtcatggaccggcaaggccagatcatcaaccccagcgaggaccccc

SEQ ID NO: 3738 - DNA, 170 bp, Homo sapiens
catctctggatgacaagccccagttcccaggggcctcggcggagtttatagataagttggaattcatccagcccaacgtcatctctggaatccccatctaccgcgtcatggaccggcaaggccagatcatcaaccccagcgaggacccccacgtgagaggcggcctcccc

SEQ ID NO: 3739 - DNA, 170 bp, Homo sapiens
ccaggggcctcggcggagtttatagataagttggaattcatccagcccaacgtcatctctggaatccccatctaccgcgtcatggaccggcaaggccagatcatcaaccccagcgaggacccccacgtgagaggcggcctcccccacttcccgtgccccccacgcccagg

SEQ ID NO: 3740 - DNA, 170 bp, Homo sapiens
agttggaattcatccagcccaacgtcatctctggaatccccatctaccgcgtcatggaccggcaaggccagatcatcaaccccagcgaggacccccacgtgagaggcggcctcccccacttcccgtgccccccacgcccaggccccttgcctgtctcctctctggtccca

SEQ ID NO: 3741 - DNA, 170 bp, Homo sapiens
gaccggcaaggccagatcatcaaccccagcgaggacccccacgtgagaggcggcctcccccacttcccgtgccccccacgcccaggccccttgcctgtctcctctctggtcccaactgccccacgtctatctgtgcctccacccgcagctgccgaaggagaaggtgctga

SEQ ID NO: 3742 - DNA, 170 bp, Homo sapiens
gcgaggacccccacgtgagaggcggcctcccccacttcccgtgccccccacgcccaggccccttgcctgtctcctctctggtcccaactgccccacgtctatctgtgcctccacccgcagctgccgaaggagaaggtgctgaagctctacaagagcatgacactgcttaa

SEQ ID NO: 3743 - DNA, 170 bp, Homo sapiens
gcctcccccacttcccgtgccccccacgcccaggccccttgcctgtctcctctctggtcccaactgccccacgtctatctgtgcctccacccgcagctgccgaaggagaaggtgctgaagctctacaagagcatgacactgcttaacaccatggaccgcatcctctatga

SEQ ID NO: 3744 - DNA, 170 bp, Homo sapiens
cacgcccaggccccttgcctgtctcctctctggtcccaactgccccacgtctatctgtgcctccacccgcagctgccgaaggagaaggtgctgaagctctacaagagcatgacactgcttaacaccatggaccgcatcctctatgagtctcagcggcaggtgcgtgggga

SEQ ID NO: 3745 - DNA, 170 bp, Homo sapiens
gtctcctctctggtcccaactgccccacgtctatctgtgcctccacccgcagctgccgaaggagaaggtgctgaagctctacaagagcatgacactgcttaacaccatggaccgcatcctctatgagtctcagcggcaggtgcgtggggacaggactaggggcggggggc

SEQ ID NO: 3746 - DNA, 170 bp, Homo sapiens
tctatctgtgcctccacccgcagctgccgaaggagaaggtgctgaagctctacaagagcatgacactgcttaacaccatggaccgcatcctctatgagtctcagcggcaggtgcgtggggacaggactaggggcggggggctggaattacctgaggtcccctacctgtgt

SEQ ID NO: 3747 - DNA, 170 bp, Homo sapiens
ccgaaggagaaggtgctgaagctctacaagagcatgacactgcttaacaccatggaccgcatcctctatgagtctcagcggcaggtgcgtggggacaggactaggggcggggggctggaattacctgaggtcccctacctgtgtttgggccaaaggaatggctcccaagg

SEQ ID NO: 3748 - DNA, 170 bp, Homo sapiens
acaagagcatgacactgcttaacaccatggaccgcatcctctatgagtctcagcggcaggtgcgtggggacaggactaggggcggggggctggaattacctgaggtcccctacctgtgtttgggccaaaggaatggctcccaaggaggacagattcttttttgggggggt

SEQ ID NO: 3749 - DNA, 170 bp, Homo sapiens
ccatggaccgcatcctctatgagtctcagcggcaggtgcgtggggacaggactaggggcggggggctggaattacctgaggtcccctacctgtgtttgggccaaaggaatggctcccaaggaggacagattcttttttgggggggttccatagagttctgagggttctct

SEQ ID NO: 3750 - DNA, 170 bp, Homo sapiens
ggaaccccagcatggcctggcccaggactggccttcaggaggactgtgaattcatggaggtgttggaagctgggcaggatttggatggctctctgtcattgcccagcataaccaattgtgggaccccggtcccctctacacccccagggccggatctccttctacatgac

SEQ ID NO: 3751 - DNA, 170 bp, Homo sapiens
aggactggccttcaggaggactgtgaattcatggaggtgttggaagctgggcaggatttggatggctctctgtcattgcccagcataaccaattgtgggaccccggtcccctctacacccccagggccggatctccttctacatgaccaactatggtgaggagggcacgc

SEQ ID NO: 3752 - DNA, 170 bp, Homo sapiens
tgtgaattcatggaggtgttggaagctgggcaggatttggatggctctctgtcattgcccagcataaccaattgtgggaccccggtcccctctacacccccagggccggatctccttctacatgaccaactatggtgaggagggcacgcacgtggggagtgccgccgccc

SEQ ID NO: 3753 - DNA, 170 bp, Homo sapiens
gggcaggatttggatggctctctgtcattgcccagcataaccaattgtgggaccccggtcccctctacacccccagggccggatctccttctacatgaccaactatggtgaggagggcacgcacgtggggagtgccgccgccctggacaacacggacctggtgtttggcc

SEQ ID NO: 3754 - DNA, 170 bp, Homo sapiens
ttgcccagcataaccaattgtgggaccccggtcccctctacacccccagggccggatctccttctacatgaccaactatggtgaggagggcacgcacgtggggagtgccgccgccctggacaacacggacctggtgtttggccagtaccgggaggcaggtacgtctgtcc

SEQ ID NO: 3755 - DNA, 170 bp, Homo sapiens
cccggtcccctctacacccccagggccggatctccttctacatgaccaactatggtgaggagggcacgcacgtggggagtgccgccgccctggacaacacggacctggtgtttggccagtaccgggaggcaggtacgtctgtccgtggtttggccctgtggtccccattg

SEQ ID NO: 3756 - DNA, 170 bp, Homo sapiens
gccggatctccttctacatgaccaactatggtgaggagggcacgcacgtggggagtgccgccgccctggacaacacggacctggtgtttggccagtaccgggaggcaggtacgtctgtccgtggtttggccctgtggtccccattgaagtgtacactttagtttttctga

SEQ ID NO: 3757 - DNA, 170 bp, Homo sapiens
tggtgaggagggcacgcacgtggggagtgccgccgccctggacaacacggacctggtgtttggccagtaccgggaggcaggtacgtctgtccgtggtttggccctgtggtccccattgaagtgtacactttagtttttctgagtgttcttccaggagcagcatagtgcca

SEQ ID NO: 3758 - DNA, 170 bp, Homo sapiens
tgccgccgccctggacaacacggacctggtgtttggccagtaccgggaggcaggtacgtctgtccgtggtttggccctgtggtccccattgaagtgtacactttagtttttctgagtgttcttccaggagcagcatagtgccaggaaggtctaaggagctggaagaagag

SEQ ID NO: 3759 - DNA, 170 bp, Homo sapiens
gacctggtgtttggccagtaccgggaggcaggtacgtctgtccgtggtttggccctgtggtccccattgaagtgtacactttagtttttctgagtgttcttccaggagcagcatagtgccaggaaggtctaaggagctggaagaagagctttccaagcaagaaagagaca

SEQ ID NO: 3760 - DNA, 170 bp, Homo sapiens
ggcagagtcagtcagtctgaacatcagtcttcctcttaaaacaagcctgagctttcctgtctgcctgccagcatgctgcaggtcacccacagggctgaactgtccccctgtactgcccactcggctaaccattgcctcctcccctcctaggtgtgctgatgtatcgggac

SEQ ID NO: 3761 - DNA, 170 bp, Homo sapiens
agtcttcctcttaaaacaagcctgagctttcctgtctgcctgccagcatgctgcaggtcacccacagggctgaactgtccccctgtactgcccactcggctaaccattgcctcctcccctcctaggtgtgctgatgtatcgggactaccccctggaactattcatggccc

SEQ ID NO: 3762 - DNA, 170 bp, Homo sapiens
gctgcaaggaacgccacttcgtcactatctcctctccactggccacgcagatccctcagggtgaggatgcatgccctgtaccttgcacatgtgcagaccaatgtcacacccctgtccaggcctcagctcttttgcctgccttctgggtggaattctgggttggtgacacc

SEQ ID NO: 3763 - DNA, 170 bp, Homo sapiens
tcactatctcctctccactggccacgcagatccctcagggtgaggatgcatgccctgtaccttgcacatgtgcagaccaatgtcacacccctgtccaggcctcagctcttttgcctgccttctgggtggaattctgggttggtgacaccactagagccctggtctgtgct

SEQ ID NO: 3764 - DNA, 170 bp, Homo sapiens
ttcctgtctgcctgccagcatgctgcaggtcacccacagggctgaactgtccccctgtactgcccactcggctaaccattgcctcctcccctcctaggtgtgctgatgtatcgggactaccccctggaactattcatggcccagtgctatggcaacatcagtgacttggg

SEQ ID NO: 3765 - DNA, 170 bp, Homo sapiens
ctgcaggtcacccacagggctgaactgtccccctgtactgcccactcggctaaccattgcctcctcccctcctaggtgtgctgatgtatcgggactaccccctggaactattcatggcccagtgctatggcaacatcagtgacttgggcaaggggcgccagatgcctgtc

SEQ ID NO: 3766 - DNA, 170 bp, Homo sapiens
ctgtccccctgtactgcccactcggctaaccattgcctcctcccctcctaggtgtgctgatgtatcgggactaccccctggaactattcatggcccagtgctatggcaacatcagtgacttgggcaaggggcgccagatgcctgtccactacggctgcaaggaacgccac

SEQ ID NO: 3767 - DNA, 170 bp, Homo sapiens
accattgcctcctcccctcctaggtgtgctgatgtatcgggactaccccctggaactattcatggcccagtgctatggcaacatcagtgacttgggcaaggggcgccagatgcctgtccactacggctgcaaggaacgccacttcgtcactatctcctctccactggcca

SEQ ID NO: 3768 - DNA, 170 bp, Homo sapiens
ggtgtgctgatgtatcgggactaccccctggaactattcatggcccagtgctatggcaacatcagtgacttgggcaaggggcgccagatgcctgtccactacggctgcaaggaacgccacttcgtcactatctcctctccactggccacgcagatccctcagggtgagga

SEQ ID NO: 3769 - DNA, 170 bp, Homo sapiens
ccctggaactattcatggcccagtgctatggcaacatcagtgacttgggcaaggggcgccagatgcctgtccactacggctgcaaggaacgccacttcgtcactatctcctctccactggccacgcagatccctcagggtgaggatgcatgccctgtaccttgcacatgt

SEQ ID NO: 3770 - DNA, 170 bp, Homo sapiens
tggcaacatcagtgacttgggcaaggggcgccagatgcctgtccactacggctgcaaggaacgccacttcgtcactatctcctctccactggccacgcagatccctcagggtgaggatgcatgccctgtaccttgcacatgtgcagaccaatgtcacacccctgtccagg

SEQ ID NO: 3771 - DNA, 170 bp, Homo sapiens
gggcgccagatgcctgtccactacggctgcaaggaacgccacttcgtcactatctcctctccactggccacgcagatccctcagggtgaggatgcatgccctgtaccttgcacatgtgcagaccaatgtcacacccctgtccaggcctcagctcttttgcctgccttctg

SEQ ID NO: 3772 - DNA, 170 bp, Homo sapiens
ggggcatcaggagctgaggtgtttcctttccccttgaagcctggtgactgctggcctgagccacgcttgagccgtgggtcatgtgagtgtgaatgagtgtgagtgcatgtgagtctccgcccctgctcaccaccctctcatcccctgcagcggtgggggcggcgtacgca

SEQ ID NO: 3773 - DNA, 170 bp, Homo sapiens
cctttccccttgaagcctggtgactgctggcctgagccacgcttgagccgtgggtcatgtgagtgtgaatgagtgtgagtgcatgtgagtctccgcccctgctcaccaccctctcatcccctgcagcggtgggggcggcgtacgcagccaagcgggccaatgccaacagg

SEQ ID NO: 3774 - DNA, 170 bp, Homo sapiens
cggcttcaacttcgctgccacacttgagtgccccatcatcttcttctgccggaacaatggctacgccatctccacgcccacctctgagcagtatcgcggcgatggcattggtatgggctctgctggctgctccccaccccgctgggatcatctccttccctccccaatcc

SEQ ID NO: 3775 - DNA, 170 bp, Homo sapiens
agtgccccatcatcttcttctgccggaacaatggctacgccatctccacgcccacctctgagcagtatcgcggcgatggcattggtatgggctctgctggctgctccccaccccgctgggatcatctccttccctccccaatcctgccaccttcctgccacccctaccct

SEQ ID NO: 3776 - DNA, 170 bp, Homo sapiens
acaatggctacgccatctccacgcccacctctgagcagtatcgcggcgatggcattggtatgggctctgctggctgctccccaccccgctgggatcatctccttccctccccaatcctgccaccttcctgccacccctaccctccttcctggttctcgtcctgtgtcctg

SEQ ID NO: 3777 - DNA, 170 bp, Homo sapiens
ccacctctgagcagtatcgcggcgatggcattggtatgggctctgctggctgctccccaccccgctgggatcatctccttccctccccaatcctgccaccttcctgccacccctaccctccttcctggttctcgtcctgtgtcctgtggcgtctggcacttggtcagcca

SEQ ID NO: 3778 - DNA, 170 bp, Homo sapiens
tggcctgagccacgcttgagccgtgggtcatgtgagtgtgaatgagtgtgagtgcatgtgagtctccgcccctgctcaccaccctctcatcccctgcagcggtgggggcggcgtacgcagccaagcgggccaatgccaacagggtcgtcatctgttacttcggcgagggg

SEQ ID NO: 3779 - DNA, 170 bp, Homo sapiens
cgtgggtcatgtgagtgtgaatgagtgtgagtgcatgtgagtctccgcccctgctcaccaccctctcatcccctgcagcggtgggggcggcgtacgcagccaagcgggccaatgccaacagggtcgtcatctgttacttcggcgagggggcagccagtgagggggacgcc

SEQ ID NO: 3780 - DNA, 170 bp, Homo sapiens
agtgcatgtgagtctccgcccctgctcaccaccctctcatcccctgcagcggtgggggcggcgtacgcagccaagcgggccaatgccaacagggtcgtcatctgttacttcggcgagggggcagccagtgagggggacgcccatgccggcttcaacttcgctgccacact

SEQ ID NO: 3781 - DNA, 170 bp, Homo sapiens
caccaccctctcatcccctgcagcggtgggggcggcgtacgcagccaagcgggccaatgccaacagggtcgtcatctgttacttcggcgagggggcagccagtgagggggacgcccatgccggcttcaacttcgctgccacacttgagtgccccatcatcttcttctgcc

SEQ ID NO: 3782 - DNA, 170 bp, Homo sapiens
tgggggcggcgtacgcagccaagcgggccaatgccaacagggtcgtcatctgttacttcggcgagggggcagccagtgagggggacgcccatgccggcttcaacttcgctgccacacttgagtgccccatcatcttcttctgccggaacaatggctacgccatctccacg

SEQ ID NO: 3783 - DNA, 170 bp, Homo sapiens
aagcgggccaatgccaacagggtcgtcatctgttacttcggcgagggggcagccagtgagggggacgcccatgccggcttcaacttcgctgccacacttgagtgccccatcatcttcttctgccggaacaatggctacgccatctccacgcccacctctgagcagtatcg

SEQ ID NO: 3784 - DNA, 170 bp, Homo sapiens
tctgttacttcggcgagggggcagccagtgagggggacgcccatgccggcttcaacttcgctgccacacttgagtgccccatcatcttcttctgccggaacaatggctacgccatctccacgcccacctctgagcagtatcgcggcgatggcattggtatgggctctgct

SEQ ID NO: 3785 - DNA, 170 bp, Homo sapiens
ccagtgagggggacgcccatgccggcttcaacttcgctgccacacttgagtgccccatcatcttcttctgccggaacaatggctacgccatctccacgcccacctctgagcagtatcgcggcgatggcattggtatgggctctgctggctgctccccaccccgctgggat

SEQ ID NO: 3786 - DNA, 170 bp, Homo sapiens
tcagccacaggagttgaggtcctgagcactcagccttgctctctgtcctctccctgctcgtccccttggcctcgtgcatgttccttatctcagccctggcctgacctgccttctctgtgtccccacagcagcacgaggccccgggtatggcatcatgtcaatccgcgtgg

SEQ ID NO: 3787 - DNA, 170 bp, Homo sapiens
gagcactcagccttgctctctgtcctctccctgctcgtccccttggcctcgtgcatgttccttatctcagccctggcctgacctgccttctctgtgtccccacagcagcacgaggccccgggtatggcatcatgtcaatccgcgtggatggtaatgatgtgtttgccgta

SEQ ID NO: 3788 - DNA, 170 bp, Homo sapiens
ctccctgctcgtccccttggcctcgtgcatgttccttatctcagccctggcctgacctgccttctctgtgtccccacagcagcacgaggccccgggtatggcatcatgtcaatccgcgtggatggtaatgatgtgtttgccgtatacaacgccacaaaggaggcccgacg

SEQ ID NO: 3789 - DNA, 170 bp, Homo sapiens
cgtgcatgttccttatctcagccctggcctgacctgccttctctgtgtccccacagcagcacgaggccccgggtatggcatcatgtcaatccgcgtggatggtaatgatgtgtttgccgtatacaacgccacaaaggaggcccgacggcgggctgtggcagagaaccagc

SEQ ID NO: 3790 - DNA, 170 bp, Homo sapiens
cctgacctgccttctctgtgtccccacagcagcacgaggccccgggtatggcatcatgtcaatccgcgtggatggtaatgatgtgtttgccgtatacaacgccacaaaggaggcccgacggcgggctgtggcagagaaccagcccttcctcatcgaggccatgacctaca

SEQ ID NO: 3791 - DNA, 170 bp, Homo sapiens
cacagcagcacgaggccccgggtatggcatcatgtcaatccgcgtggatggtaatgatgtgtttgccgtatacaacgccacaaaggaggcccgacggcgggctgtggcagagaaccagcccttcctcatcgaggccatgacctacaggtgcctgccgctccccccgtcag

SEQ ID NO: 3792 - DNA, 170 bp, Homo sapiens
ggcatcatgtcaatccgcgtggatggtaatgatgtgtttgccgtatacaacgccacaaaggaggcccgacggcgggctgtggcagagaaccagcccttcctcatcgaggccatgacctacaggtgcctgccgctccccccgtcagcacccccacagcactgacagccacc

SEQ ID NO: 3793 - DNA, 170 bp, Homo sapiens
tgatgtgtttgccgtatacaacgccacaaaggaggcccgacggcgggctgtggcagagaaccagcccttcctcatcgaggccatgacctacaggtgcctgccgctccccccgtcagcacccccacagcactgacagccaccgtagcatcttcctcatatcgatcactgtc

SEQ ID NO: 3794 - DNA, 170 bp, Homo sapiens
acaaaggaggcccgacggcgggctgtggcagagaaccagcccttcctcatcgaggccatgacctacaggtgcctgccgctccccccgtcagcacccccacagcactgacagccaccgtagcatcttcctcatatcgatcactgtctccaaaacatggccttatcacctga

SEQ ID NO: 3795 - DNA, 170 bp, Homo sapiens
ctgtggcagagaaccagcccttcctcatcgaggccatgacctacaggtgcctgccgctccccccgtcagcacccccacagcactgacagccaccgtagcatcttcctcatatcgatcactgtctccaaaacatggccttatcacctgatgttgcatctcccccttgcctt

SEQ ID NO: 3796 - DNA, 170 bp, Homo sapiens
cttatcacctgatgttgcatctcccccttgcctttattccgtttccactcctccttccctagttcatcccccatcctccctcctgacccccactccagggagcccacactgacctggggccccttgcccctgtgcaggatcgggcaccacagcaccagtgacgacagttc

SEQ ID NO: 3797 - DNA, 170 bp, Homo sapiens
tcccccttgcctttattccgtttccactcctccttccctagttcatcccccatcctccctcctgacccccactccagggagcccacactgacctggggccccttgcccctgtgcaggatcgggcaccacagcaccagtgacgacagttcagcgtaccgctcggtggatga

SEQ ID NO: 3798 - DNA, 170 bp, Homo sapiens
tgagccaaggctggtgggatgaggagcaggagaaggcctggaggaagcagtcccgcaggaaggtgagggtgccccgcccgggagggtgtgctgggggctgctgcggcctgcagagcttgggaaggatttgtggaacaccgaactgggaggctcagggataaccccagtga

SEQ ID NO: 3799 - DNA, 170 bp, Homo sapiens
gcaggagaaggcctggaggaagcagtcccgcaggaaggtgagggtgccccgcccgggagggtgtgctgggggctgctgcggcctgcagagcttgggaaggatttgtggaacaccgaactgggaggctcagggataaccccagtgatgtctcagatgtggcctgtggagcc

SEQ ID NO: 3800 - DNA, 170 bp, Homo sapiens
tcctccttccctagttcatcccccatcctccctcctgacccccactccagggagcccacactgacctggggccccttgcccctgtgcaggatcgggcaccacagcaccagtgacgacagttcagcgtaccgctcggtggatgaggtcaattactgggataaacaggacca

SEQ ID NO: 3801 - DNA, 170 bp, Homo sapiens
ccatcctccctcctgacccccactccagggagcccacactgacctggggccccttgcccctgtgcaggatcgggcaccacagcaccagtgacgacagttcagcgtaccgctcggtggatgaggtcaattactgggataaacaggaccaccccatctcccggctgcggcac

SEQ ID NO: 3802 - DNA, 170 bp, Homo sapiens
ggagcccacactgacctggggccccttgcccctgtgcaggatcgggcaccacagcaccagtgacgacagttcagcgtaccgctcggtggatgaggtcaattactgggataaacaggaccaccccatctcccggctgcggcactatctgctgagccaaggctggtgggatg

SEQ ID NO: 3803 - DNA, 170 bp, Homo sapiens
tgcccctgtgcaggatcgggcaccacagcaccagtgacgacagttcagcgtaccgctcggtggatgaggtcaattactgggataaacaggaccaccccatctcccggctgcggcactatctgctgagccaaggctggtgggatgaggagcaggagaaggcctggaggaag

SEQ ID NO: 3804 - DNA, 170 bp, Homo sapiens
ccacagcaccagtgacgacagttcagcgtaccgctcggtggatgaggtcaattactgggataaacaggaccaccccatctcccggctgcggcactatctgctgagccaaggctggtgggatgaggagcaggagaaggcctggaggaagcagtcccgcaggaaggtgaggg

SEQ ID NO: 3805 - DNA, 170 bp, Homo sapiens
agcgtaccgctcggtggatgaggtcaattactgggataaacaggaccaccccatctcccggctgcggcactatctgctgagccaaggctggtgggatgaggagcaggagaaggcctggaggaagcagtcccgcaggaaggtgagggtgccccgcccgggagggtgtgctg

SEQ ID NO: 3806 - DNA, 170 bp, Homo sapiens
tcaattactgggataaacaggaccaccccatctcccggctgcggcactatctgctgagccaaggctggtgggatgaggagcaggagaaggcctggaggaagcagtcccgcaggaaggtgagggtgccccgcccgggagggtgtgctgggggctgctgcggcctgcagagc

SEQ ID NO: 3807 - DNA, 170 bp, Homo sapiens
ctcccggctgcggcactatctgctgagccaaggctggtgggatgaggagcaggagaaggcctggaggaagcagtcccgcaggaaggtgagggtgccccgcccgggagggtgtgctgggggctgctgcggcctgcagagcttgggaaggatttgtggaacaccgaactggg

SEQ ID NO: 3808 - DNA, 170 bp, Homo sapiens
cattacacttctgctaggataatcatttccattgtcgaggtgggaacacaaaggcttggagtggttaattccttgccaaggccccgcaggaggaagcagggtcctgcatgggaggccggctagcctgcccactgccccatgtccccacaggtgatggaggcctttgagca

SEQ ID NO: 3809 - DNA, 170 bp, Homo sapiens
tcatttccattgtcgaggtgggaacacaaaggcttggagtggttaattccttgccaaggccccgcaggaggaagcagggtcctgcatgggaggccggctagcctgcccactgccccatgtccccacaggtgatggaggcctttgagcaggccgagcggaagcccaaaccc

SEQ ID NO: 3810 - DNA, 170 bp, Homo sapiens
caggagtctctggcccgccacctgcagacctacggggagcactacccactggatcacttcgataagtgagacctgctcagcccacccccacccatcctcagctaccccgagaggtagccccactctaaggggagcagggggacctgacagcacaccactgtcttccccag

SEQ ID NO: 3811 - DNA, 170 bp, Homo sapiens
gacctacggggagcactacccactggatcacttcgataagtgagacctgctcagcccacccccacccatcctcagctaccccgagaggtagccccactctaaggggagcagggggacctgacagcacaccactgtcttccccagtcagctccctctaaaatactcagcgg

SEQ ID NO: 3812 - DNA, 170 bp, Homo sapiens
aaggcttggagtggttaattccttgccaaggccccgcaggaggaagcagggtcctgcatgggaggccggctagcctgcccactgccccatgtccccacaggtgatggaggcctttgagcaggccgagcggaagcccaaacccaaccccaacctactcttctcagacgtgt

SEQ ID NO: 3813 - DNA, 170 bp, Homo sapiens
ttgccaaggccccgcaggaggaagcagggtcctgcatgggaggccggctagcctgcccactgccccatgtccccacaggtgatggaggcctttgagcaggccgagcggaagcccaaacccaaccccaacctactcttctcagacgtgtatcaggagatgcccgcccagct

SEQ ID NO: 3814 - DNA, 170 bp, Homo sapiens
gtcctgcatgggaggccggctagcctgcccactgccccatgtccccacaggtgatggaggcctttgagcaggccgagcggaagcccaaacccaaccccaacctactcttctcagacgtgtatcaggagatgcccgcccagctccgcaagcagcaggagtctctggcccgc

SEQ ID NO: 3815 - DNA, 170 bp, Homo sapiens
cccactgccccatgtccccacaggtgatggaggcctttgagcaggccgagcggaagcccaaacccaaccccaacctactcttctcagacgtgtatcaggagatgcccgcccagctccgcaagcagcaggagtctctggcccgccacctgcagacctacggggagcactac

SEQ ID NO: 3816 - DNA, 170 bp, Homo sapiens
tggaggcctttgagcaggccgagcggaagcccaaacccaaccccaacctactcttctcagacgtgtatcaggagatgcccgcccagctccgcaagcagcaggagtctctggcccgccacctgcagacctacggggagcactacccactggatcacttcgataagtgagac

SEQ ID NO: 3817 - DNA, 170 bp, Homo sapiens
gagcggaagcccaaacccaaccccaacctactcttctcagacgtgtatcaggagatgcccgcccagctccgcaagcagcaggagtctctggcccgccacctgcagacctacggggagcactacccactggatcacttcgataagtgagacctgctcagcccacccccacc

SEQ ID NO: 3818 - DNA, 170 bp, Homo sapiens
ctcttctcagacgtgtatcaggagatgcccgcccagctccgcaagcagcaggagtctctggcccgccacctgcagacctacggggagcactacccactggatcacttcgataagtgagacctgctcagcccacccccacccatcctcagctaccccgagaggtagcccca

SEQ ID NO: 3819 - DNA, 170 bp, Homo sapiens
gagatgcccgcccagctccgcaagcagcaggagtctctggcccgccacctgcagacctacggggagcactacccactggatcacttcgataagtgagacctgctcagcccacccccacccatcctcagctaccccgagaggtagccccactctaaggggagcagggggac

SEQ ID NO: 3820 - DNA, 170 bp, Homo sapiens
ccccgcccctaaatttccagttccgattggtctgtttcatgggaccgcccctctggcccgaccaatgtggaagcctcctcgggtgctccgccctccccgcaggcggcgtgcggctgcatagcctgagaatcccggtggtgagcggggatggcggttgtagcggcggctgc

SEQ ID NO: 3821 - DNA, 170 bp, Homo sapiens
gtttcatgggaccgcccctctggcccgaccaatgtggaagcctcctcgggtgctccgccctccccgcaggcggcgtgcggctgcatagcctgagaatcccggtggtgagcggggatggcggttgtagcggcggctgccggctggctactcaggctcagggcggcaggggc

SEQ ID NO: 3822 - DNA, 170 bp, Homo sapiens
ctttttgcaccccgccgcgactgtcgaggatgcggcccagaggcggcaggtggctcattttactttccagccagatccggagccccgggagtacggtgagccctgggactgcccactcggtcccgctgcagcccggactcccaggctcgcaggcgcccgcgaggggcagg

SEQ ID NO: 3823 - DNA, 170 bp, Homo sapiens
ggcccagaggcggcaggtggctcattttactttccagccagatccggagccccgggagtacggtgagccctgggactgcccactcggtcccgctgcagcccggactcccaggctcgcaggcgcccgcgaggggcaggggccggcaggctgcaatccttgcatcccagctt

SEQ ID NO: 3824 - DNA, 170 bp, Homo sapiens
tcattttactttccagccagatccggagccccgggagtacggtgagccctgggactgcccactcggtcccgctgcagcccggactcccaggctcgcaggcgcccgcgaggggcaggggccggcaggctgcaatccttgcatcccagcttattaacttcctgactctctgg

SEQ ID NO: 3825 - DNA, 170 bp, Homo sapiens
ctctggcccgaccaatgtggaagcctcctcgggtgctccgccctccccgcaggcggcgtgcggctgcatagcctgagaatcccggtggtgagcggggatggcggttgtagcggcggctgccggctggctactcaggctcagggcggcaggggctgaggggcactggcgtc

SEQ ID NO: 3826 - DNA, 170 bp, Homo sapiens
cctcctcgggtgctccgccctccccgcaggcggcgtgcggctgcatagcctgagaatcccggtggtgagcggggatggcggttgtagcggcggctgccggctggctactcaggctcagggcggcaggggctgaggggcactggcgtcggcttcctggcgcggggctggcg

SEQ ID NO: 3827 - DNA, 170 bp, Homo sapiens
gcaggcggcgtgcggctgcatagcctgagaatcccggtggtgagcggggatggcggttgtagcggcggctgccggctggctactcaggctcagggcggcaggggctgaggggcactggcgtcggcttcctggcgcggggctggcgcggggctttttgcaccccgccgcga

SEQ ID NO: 3828 - DNA, 170 bp, Homo sapiens
gagaatcccggtggtgagcggggatggcggttgtagcggcggctgccggctggctactcaggctcagggcggcaggggctgaggggcactggcgtcggcttcctggcgcggggctggcgcggggctttttgcaccccgccgcgactgtcgaggatgcggcccagaggcgg

SEQ ID NO: 3829 - DNA, 170 bp, Homo sapiens
agcggcggctgccggctggctactcaggctcagggcggcaggggctgaggggcactggcgtcggcttcctggcgcggggctggcgcggggctttttgcaccccgccgcgactgtcgaggatgcggcccagaggcggcaggtggctcattttactttccagccagatccgg

SEQ ID NO: 3830 - DNA, 170 bp, Homo sapiens
gctactcaggctcagggcggcaggggctgaggggcactggcgtcggcttcctggcgcggggctggcgcggggctttttgcaccccgccgcgactgtcgaggatgcggcccagaggcggcaggtggctcattttactttccagccagatccggagccccgggagtacggtg

SEQ ID NO: 3831 - DNA, 170 bp, Homo sapiens
ctgaggggcactggcgtcggcttcctggcgcggggctggcgcggggctttttgcaccccgccgcgactgtcgaggatgcggcccagaggcggcaggtggctcattttactttccagccagatccggagccccgggagtacggtgagccctgggactgcccactcggtccc

SEQ ID NO: 3832 - DNA, 170 bp, Homo sapiens
ggggctggcgcggggctttttgcaccccgccgcgactgtcgaggatgcggcccagaggcggcaggtggctcattttactttccagccagatccggagccccgggagtacggtgagccctgggactgcccactcggtcccgctgcagcccggactcccaggctcgcaggcg

SEQ ID NO: 3833 - DNA, 170 bp, Homo sapiens
tcatattacagtatacttaaatatttttaatgtccttagatgcaattgtatttttagtaagtgaaatattttaagttgcactatttcatttctgtgagtaaaaaaaattcttgaagttaagcatcctgactctgtctgcaggaggaatgtttcttgaacctagaggctcc

SEQ ID NO: 3834 - DNA, 170 bp, Homo sapiens
tgtccttagatgcaattgtatttttagtaagtgaaatattttaagttgcactatttcatttctgtgagtaaaaaaaattcttgaagttaagcatcctgactctgtctgcaggaggaatgtttcttgaacctagaggctcctatatcaagagtatgtggttatgacacacc

SEQ ID NO: 3835 - DNA, 170 bp, Homo sapiens
tgcccttcgaaaaatgatcaactattgaccatataggtaggtatgcatcttgagaaagctactatgtgcccctgacattaacgtactgttaaccaagacacagcaatcatcagtgttttgatggtaacaaactttgatggtaaagttggtaaaaggcaactttcagaaga

SEQ ID NO: 3836 - DNA, 170 bp, Homo sapiens
tttagtaagtgaaatattttaagttgcactatttcatttctgtgagtaaaaaaaattcttgaagttaagcatcctgactctgtctgcaggaggaatgtttcttgaacctagaggctcctatatcaagagtatgtggttatgacacaccatttcctcacatttttgaacca

SEQ ID NO: 3837 - DNA, 170 bp, Homo sapiens
gcactatttcatttctgtgagtaaaaaaaattcttgaagttaagcatcctgactctgtctgcaggaggaatgtttcttgaacctagaggctcctatatcaagagtatgtggttatgacacaccatttcctcacatttttgaaccattctacatcccagacaaatggaagt

SEQ ID NO: 3838 - DNA, 170 bp, Homo sapiens
aaaaaattcttgaagttaagcatcctgactctgtctgcaggaggaatgtttcttgaacctagaggctcctatatcaagagtatgtggttatgacacaccatttcctcacatttttgaaccattctacatcccagacaaatggaagtgttatgatgcccttcgaaaaatga

SEQ ID NO: 3839 - DNA, 170 bp, Homo sapiens
tctgtctgcaggaggaatgtttcttgaacctagaggctcctatatcaagagtatgtggttatgacacaccatttcctcacatttttgaaccattctacatcccagacaaatggaagtgttatgatgcccttcgaaaaatgatcaactattgaccatataggtaggtatgc

SEQ ID NO: 3840 - DNA, 170 bp, Homo sapiens
tgaacctagaggctcctatatcaagagtatgtggttatgacacaccatttcctcacatttttgaaccattctacatcccagacaaatggaagtgttatgatgcccttcgaaaaatgatcaactattgaccatataggtaggtatgcatcttgagaaagctactatgtgcc

SEQ ID NO: 3841 - DNA, 170 bp, Homo sapiens
gagtatgtggttatgacacaccatttcctcacatttttgaaccattctacatcccagacaaatggaagtgttatgatgcccttcgaaaaatgatcaactattgaccatataggtaggtatgcatcttgagaaagctactatgtgcccctgacattaacgtactgttaacc

SEQ ID NO: 3842 - DNA, 170 bp, Homo sapiens
ttcctcacatttttgaaccattctacatcccagacaaatggaagtgttatgatgcccttcgaaaaatgatcaactattgaccatataggtaggtatgcatcttgagaaagctactatgtgcccctgacattaacgtactgttaaccaagacacagcaatcatcagtgttt

SEQ ID NO: 3843 - DNA, 170 bp, Homo sapiens
tcccagacaaatggaagtgttatgatgcccttcgaaaaatgatcaactattgaccatataggtaggtatgcatcttgagaaagctactatgtgcccctgacattaacgtactgttaaccaagacacagcaatcatcagtgttttgatggtaacaaactttgatggtaaag

SEQ ID NO: 3844 - DNA, 170 bp, Homo sapiens
tcttatagtattattgtaaataattcagcaatttgcataatatctttctttgtaccttgattttagtcaagttgtaattaactgttaagaaactggttgtttttatgtattttacaacacacgaaatgattttttttttgattttcacagggcaaactcagaaaatgaat

SEQ ID NO: 3845 - DNA, 170 bp, Homo sapiens
tcagcaatttgcataatatctttctttgtaccttgattttagtcaagttgtaattaactgttaagaaactggttgtttttatgtattttacaacacacgaaatgattttttttttgattttcacagggcaaactcagaaaatgaatcttttccagtctgtaacaagtgcc

SEQ ID NO: 3846 - DNA, 170 bp, Homo sapiens
tgtaccttgattttagtcaagttgtaattaactgttaagaaactggttgtttttatgtattttacaacacacgaaatgattttttttttgattttcacagggcaaactcagaaaatgaatcttttccagtctgtaacaagtgccttggataactcattggccaaagatcc

SEQ ID NO: 3847 - DNA, 170 bp, Homo sapiens
ttaactgttaagaaactggttgtttttatgtattttacaacacacgaaatgattttttttttgattttcacagggcaaactcagaaaatgaatcttttccagtctgtaacaagtgccttggataactcattggccaaagatcctactgcaggtaaccctgatatgtgcct

SEQ ID NO: 3848 - DNA, 170 bp, Homo sapiens
tgtttttatgtattttacaacacacgaaatgattttttttttgattttcacagggcaaactcagaaaatgaatcttttccagtctgtaacaagtgccttggataactcattggccaaagatcctactgcaggtaaccctgatatgtgcctgaattgtggtagctgtgtta

SEQ ID NO: 3849 - DNA, 170 bp, Homo sapiens
tgattttttttttgattttcacagggcaaactcagaaaatgaatcttttccagtctgtaacaagtgccttggataactcattggccaaagatcctactgcaggtaaccctgatatgtgcctgaattgtggtagctgtgttaattccagaattgaagatttgcttaaaata

SEQ ID NO: 3850 - DNA, 170 bp, Homo sapiens
agggcaaactcagaaaatgaatcttttccagtctgtaacaagtgccttggataactcattggccaaagatcctactgcaggtaaccctgatatgtgcctgaattgtggtagctgtgttaattccagaattgaagatttgcttaaaatatttatgtggagctcaatggtta

SEQ ID NO: 3851 - DNA, 170 bp, Homo sapiens
agtctgtaacaagtgccttggataactcattggccaaagatcctactgcaggtaaccctgatatgtgcctgaattgtggtagctgtgttaattccagaattgaagatttgcttaaaatatttatgtggagctcaatggttaacattgtatctacctgacattttcaaagg

SEQ ID NO: 3852 - DNA, 170 bp, Homo sapiens
actcattggccaaagatcctactgcaggtaaccctgatatgtgcctgaattgtggtagctgtgttaattccagaattgaagatttgcttaaaatatttatgtggagctcaatggttaacattgtatctacctgacattttcaaaggtatgattggggctaaataatcaaa

SEQ ID NO: 3853 - DNA, 170 bp, Homo sapiens
tgagaaaccttgatcgagatctatggtccatttatcttttgtgatttaaaatgtaaacatttaaattacttatttctcattgttagtattatttagagattattaaataaaatgtattatttaaatactgtttttcagtaatatttggtgaagatgttgcctttggtgga

SEQ ID NO: 3854 - DNA, 170 bp, Homo sapiens
tggtccatttatcttttgtgatttaaaatgtaaacatttaaattacttatttctcattgttagtattatttagagattattaaataaaatgtattatttaaatactgtttttcagtaatatttggtgaagatgttgcctttggtggagtctttagatgcactgttggctt

SEQ ID NO: 3855 - DNA, 170 bp, Homo sapiens
tgtaaacatttaaattacttatttctcattgttagtattatttagagattattaaataaaatgtattatttaaatactgtttttcagtaatatttggtgaagatgttgcctttggtggagtctttagatgcactgttggcttgcgagacaaatatggtaagtaaatacct

SEQ ID NO: 3856 - DNA, 170 bp, Homo sapiens
tcattgttagtattatttagagattattaaataaaatgtattatttaaatactgtttttcagtaatatttggtgaagatgttgcctttggtggagtctttagatgcactgttggcttgcgagacaaatatggtaagtaaatacctatatgaatagtattctgatagaact

SEQ ID NO: 3857 - DNA, 170 bp, Homo sapiens
ttaaataaaatgtattatttaaatactgtttttcagtaatatttggtgaagatgttgcctttggtggagtctttagatgcactgttggcttgcgagacaaatatggtaagtaaatacctatatgaatagtattctgatagaacttttactaaaagatcttaaaaatacaa

SEQ ID NO: 3858 - DNA, 170 bp, Homo sapiens
actgtttttcagtaatatttggtgaagatgttgcctttggtggagtctttagatgcactgttggcttgcgagacaaatatggtaagtaaatacctatatgaatagtattctgatagaacttttactaaaagatcttaaaaatacaaaatatgcctactaaattttttgtc

SEQ ID NO: 3859 - DNA, 170 bp, Homo sapiens
tgttgcctttggtggagtctttagatgcactgttggcttgcgagacaaatatggtaagtaaatacctatatgaatagtattctgatagaacttttactaaaagatcttaaaaatacaaaatatgcctactaaattttttgtcatatccccattgtatggatgaattcctt

SEQ ID NO: 3860 - DNA, 170 bp, Homo sapiens
tagatgcactgttggcttgcgagacaaatatggtaagtaaatacctatatgaatagtattctgatagaacttttactaaaagatcttaaaaatacaaaatatgcctactaaattttttgtcatatccccattgtatggatgaattccttttcatttccaacgccacccgc

SEQ ID NO: 3861 - DNA, 170 bp, Homo sapiens
tggctagccatactctttattttctgtttcctctacctgttctatacttctccatcccattattagtttactgaatttttaaatgtattatgcatgacattactctcatttgccacattaacctttttttcttttctattttaaggaaaagatagagtttttaatacccc

SEQ ID NO: 3862 - DNA, 170 bp, Homo sapiens
tgtttcctctacctgttctatacttctccatcccattattagtttactgaatttttaaatgtattatgcatgacattactctcatttgccacattaacctttttttcttttctattttaaggaaaagatagagtttttaataccccattgtgtgaacaaggaattgttgg

SEQ ID NO: 3863 - DNA, 170 bp, Homo sapiens
agattatattttccctgcatttgatcaggtaagtgaatgaacatttctaaggttgttcattcattgaaatattcaagtattgccgctacccttccacccacccttacctgcattctaaacattttattatccttttactaatgtattacaattataattttgttatgagc

SEQ ID NO: 3864 - DNA, 170 bp, Homo sapiens
ttctccatcccattattagtttactgaatttttaaatgtattatgcatgacattactctcatttgccacattaacctttttttcttttctattttaaggaaaagatagagtttttaataccccattgtgtgaacaaggaattgttggatttggaatcggaattgcggtca

SEQ ID NO: 3865 - DNA, 170 bp, Homo sapiens
actgaatttttaaatgtattatgcatgacattactctcatttgccacattaacctttttttcttttctattttaaggaaaagatagagtttttaataccccattgtgtgaacaaggaattgttggatttggaatcggaattgcggtcactggagctactgccattgcgga

SEQ ID NO: 3866 - DNA, 170 bp, Homo sapiens
tactctcatttgccacattaacctttttttcttttctattttaaggaaaagatagagtttttaataccccattgtgtgaacaaggaattgttggatttggaatcggaattgcggtcactggagctactgccattgcggaaattcagtttgcagattatattttccctgca

SEQ ID NO: 3867 - DNA, 170 bp, Homo sapiens
ctttttttcttttctattttaaggaaaagatagagtttttaataccccattgtgtgaacaaggaattgttggatttggaatcggaattgcggtcactggagctactgccattgcggaaattcagtttgcagattatattttccctgcatttgatcaggtaagtgaatgaa

SEQ ID NO: 3868 - DNA, 170 bp, Homo sapiens
aagatagagtttttaataccccattgtgtgaacaaggaattgttggatttggaatcggaattgcggtcactggagctactgccattgcggaaattcagtttgcagattatattttccctgcatttgatcaggtaagtgaatgaacatttctaaggttgttcattcattga

SEQ ID NO: 3869 - DNA, 170 bp, Homo sapiens
tgtgtgaacaaggaattgttggatttggaatcggaattgcggtcactggagctactgccattgcggaaattcagtttgcagattatattttccctgcatttgatcaggtaagtgaatgaacatttctaaggttgttcattcattgaaatattcaagtattgccgctaccc

SEQ ID NO: 3870 - DNA, 170 bp, Homo sapiens
tggaatcggaattgcggtcactggagctactgccattgcggaaattcagtttgcagattatattttccctgcatttgatcaggtaagtgaatgaacatttctaaggttgttcattcattgaaatattcaagtattgccgctacccttccacccacccttacctgcattct

SEQ ID NO: 3871 - DNA, 170 bp, Homo sapiens
actgccattgcggaaattcagtttgcagattatattttccctgcatttgatcaggtaagtgaatgaacatttctaaggttgttcattcattgaaatattcaagtattgccgctacccttccacccacccttacctgcattctaaacattttattatccttttactaatgt

SEQ ID NO: 3872 - DNA, 170 bp, Homo sapiens
agggagggagggaaagactcattgtgccttgggaagggaaggaaggaagggagggagggaggaagaacggaaggagattggaagggaaggactcattgtgccatgccccgtctttctttctgaccctcagattgttaatgaagctgccaagtatcgctatcgctctgggg

SEQ ID NO: 3873 - DNA, 170 bp, Homo sapiens
gccttgggaagggaaggaaggaagggagggagggaggaagaacggaaggagattggaagggaaggactcattgtgccatgccccgtctttctttctgaccctcagattgttaatgaagctgccaagtatcgctatcgctctggggatctttttaactgtggaagcctcac

SEQ ID NO: 3874 - DNA, 170 bp, Homo sapiens
cctgaagcattttttgcccattgcccaggaatcaaggtatgttcatttatgtactttatttgatttctatttgatgtttccattttgattcattctatttaatatctatgcttatctagaggaaagaaaacaaacaggattcttggaatttatgtgaacttaactgtatt

SEQ ID NO: 3875 - DNA, 170 bp, Homo sapiens
agggagggaggaagaacggaaggagattggaagggaaggactcattgtgccatgccccgtctttctttctgaccctcagattgttaatgaagctgccaagtatcgctatcgctctggggatctttttaactgtggaagcctcactatccggtccccttggggctgtgttg

SEQ ID NO: 3876 - DNA, 170 bp, Homo sapiens
ttggaagggaaggactcattgtgccatgccccgtctttctttctgaccctcagattgttaatgaagctgccaagtatcgctatcgctctggggatctttttaactgtggaagcctcactatccggtccccttggggctgtgttggtcatggggctctctatcattctcag

SEQ ID NO: 3877 - DNA, 170 bp, Homo sapiens
ccatgccccgtctttctttctgaccctcagattgttaatgaagctgccaagtatcgctatcgctctggggatctttttaactgtggaagcctcactatccggtccccttggggctgtgttggtcatggggctctctatcattctcagagtcctgaagcattttttgccca

SEQ ID NO: 3878 - DNA, 170 bp, Homo sapiens
cctcagattgttaatgaagctgccaagtatcgctatcgctctggggatctttttaactgtggaagcctcactatccggtccccttggggctgtgttggtcatggggctctctatcattctcagagtcctgaagcattttttgcccattgcccaggaatcaaggtatgttc

SEQ ID NO: 3879 - DNA, 170 bp, Homo sapiens
cgctatcgctctggggatctttttaactgtggaagcctcactatccggtccccttggggctgtgttggtcatggggctctctatcattctcagagtcctgaagcattttttgcccattgcccaggaatcaaggtatgttcatttatgtactttatttgatttctatttga

SEQ ID NO: 3880 - DNA, 170 bp, Homo sapiens
actgtggaagcctcactatccggtccccttggggctgtgttggtcatggggctctctatcattctcagagtcctgaagcattttttgcccattgcccaggaatcaaggtatgttcatttatgtactttatttgatttctatttgatgtttccattttgattcattctatt

SEQ ID NO: 3881 - DNA, 170 bp, Homo sapiens
ccccttggggctgtgttggtcatggggctctctatcattctcagagtcctgaagcattttttgcccattgcccaggaatcaaggtatgttcatttatgtactttatttgatttctatttgatgtttccattttgattcattctatttaatatctatgcttatctagagga

SEQ ID NO: 3882 - DNA, 170 bp, Homo sapiens
ggggctctctatcattctcagagtcctgaagcattttttgcccattgcccaggaatcaaggtatgttcatttatgtactttatttgatttctatttgatgtttccattttgattcattctatttaatatctatgcttatctagaggaaagaaaacaaacaggattcttgg

SEQ ID NO: 3883 - DNA, 170 bp, Homo sapiens
cttaataagtgataattaggcttaaaataaatagccaatatctatttttaattagtaacaattgattatttaaatatcagcccttcttagcagcgagtttactgggatatatttttactaaaattgtcttaaaaaaatctgtttttgcaggtggttatacccagaagccc

SEQ ID NO: 3884 - DNA, 170 bp, Homo sapiens
ttaaaataaatagccaatatctatttttaattagtaacaattgattatttaaatatcagcccttcttagcagcgagtttactgggatatatttttactaaaattgtcttaaaaaaatctgtttttgcaggtggttatacccagaagccctttccaggccaaaggacttct

SEQ ID NO: 3885 - DNA, 170 bp, Homo sapiens
ttagtaacaattgattatttaaatatcagcccttcttagcagcgagtttactgggatatatttttactaaaattgtcttaaaaaaatctgtttttgcaggtggttatacccagaagccctttccaggccaaaggacttcttttgtcatgcatagaggataaaaatccttg

SEQ ID NO: 3886 - DNA, 170 bp, Homo sapiens
gcccttcttagcagcgagtttactgggatatatttttactaaaattgtcttaaaaaaatctgtttttgcaggtggttatacccagaagccctttccaggccaaaggacttcttttgtcatgcatagaggataaaaatccttgtatattttttgaacctaaaatactttac

SEQ ID NO: 3887 - DNA, 170 bp, Homo sapiens
gtttactgggatatatttttactaaaattgtcttaaaaaaatctgtttttgcaggtggttatacccagaagccctttccaggccaaaggacttcttttgtcatgcatagaggataaaaatccttgtatattttttgaacctaaaatactttacagggcagcaggtaaaga

SEQ ID NO: 3888 - DNA, 170 bp, Homo sapiens
gtcttaaaaaaatctgtttttgcaggtggttatacccagaagccctttccaggccaaaggacttcttttgtcatgcatagaggataaaaatccttgtatattttttgaacctaaaatactttacagggcagcaggtaaagattttctttattttatatttgtgaatatct

SEQ ID NO: 3889 - DNA, 170 bp, Homo sapiens
tggttatacccagaagccctttccaggccaaaggacttcttttgtcatgcatagaggataaaaatccttgtatattttttgaacctaaaatactttacagggcagcaggtaaagattttctttattttatatttgtgaatatctttatatactttgttttttatagctct

SEQ ID NO: 3890 - DNA, 170 bp, Homo sapiens
ggccaaaggacttcttttgtcatgcatagaggataaaaatccttgtatattttttgaacctaaaatactttacagggcagcaggtaaagattttctttattttatatttgtgaatatctttatatactttgttttttatagctctaaaagttatatcttttttttctata

SEQ ID NO: 3891 - DNA, 170 bp, Homo sapiens
tagaggataaaaatccttgtatattttttgaacctaaaatactttacagggcagcaggtaaagattttctttattttatatttgtgaatatctttatatactttgttttttatagctctaaaagttatatcttttttttctatatggttgatttatattttccttgtaga

SEQ ID NO: 3892 - DNA, 170 bp, Homo sapiens
tttttgaacctaaaatactttacagggcagcaggtaaagattttctttattttatatttgtgaatatctttatatactttgttttttatagctctaaaagttatatcttttttttctatatggttgatttatattttccttgtagaaagaatcttgatttttttggtatt

SEQ ID NO: 3893 - DNA, 170 bp, Homo sapiens
tgttttaagtaatacagaatttagagaaacaaaaaataaaataaagctttgctacagtgagcttcttaaattattttatgcacaagtgtcacctcagaaaaaatgtccttttttttttttcctgttctgtatttagcggaagaagtccctatagaaccatacaacatccc

SEQ ID NO: 3894 - DNA, 170 bp, Homo sapiens
caaaaaataaaataaagctttgctacagtgagcttcttaaattattttatgcacaagtgtcacctcagaaaaaatgtccttttttttttttcctgttctgtatttagcggaagaagtccctatagaaccatacaacatcccactgtcccaggccgaagtcatacaggaag

SEQ ID NO: 3895 - DNA, 170 bp, Homo sapiens
tgagcttcttaaattattttatgcacaagtgtcacctcagaaaaaatgtccttttttttttttcctgttctgtatttagcggaagaagtccctatagaaccatacaacatcccactgtcccaggccgaagtcatacaggaagggagtgatgttactctagttgcctgggg

SEQ ID NO: 3896 - DNA, 170 bp, Homo sapiens
tgcacaagtgtcacctcagaaaaaatgtccttttttttttttcctgttctgtatttagcggaagaagtccctatagaaccatacaacatcccactgtcccaggccgaagtcatacaggaagggagtgatgttactctagttgcctggggcactcaggtgagtagcattga

SEQ ID NO: 3897 - DNA, 170 bp, Homo sapiens
tgtccttttttttttttcctgttctgtatttagcggaagaagtccctatagaaccatacaacatcccactgtcccaggccgaagtcatacaggaagggagtgatgttactctagttgcctggggcactcaggtgagtagcattgatcccaactgttaaaacctacgttgt

SEQ ID NO: 3898 - DNA, 170 bp, Homo sapiens
gtatttagcggaagaagtccctatagaaccatacaacatcccactgtcccaggccgaagtcatacaggaagggagtgatgttactctagttgcctggggcactcaggtgagtagcattgatcccaactgttaaaacctacgttgtgcttggaagctctcattttaaatcc

SEQ ID NO: 3899 - DNA, 170 bp, Homo sapiens
agaaccatacaacatcccactgtcccaggccgaagtcatacaggaagggagtgatgttactctagttgcctggggcactcaggtgagtagcattgatcccaactgttaaaacctacgttgtgcttggaagctctcattttaaatcctgatacatgaaaaattgaaaacga

SEQ ID NO: 3900 - DNA, 170 bp, Homo sapiens
ggccgaagtcatacaggaagggagtgatgttactctagttgcctggggcactcaggtgagtagcattgatcccaactgttaaaacctacgttgtgcttggaagctctcattttaaatcctgatacatgaaaaattgaaaacgatgttttctttatatctcagattaagtc

SEQ ID NO: 3901 - DNA, 170 bp, Homo sapiens
gtgatgttactctagttgcctggggcactcaggtgagtagcattgatcccaactgttaaaacctacgttgtgcttggaagctctcattttaaatcctgatacatgaaaaattgaaaacgatgttttctttatatctcagattaagtctggtgctactgatgctaatttct

SEQ ID NO: 3902 - DNA, 170 bp, Homo sapiens
caacatatttaaaacaaatttataaattctccatgcagatcagttcctgagactttaaatactgtctctaatagtgacatcagcattcaactagtttttgaggctagaacctttgtagtcattctctgcatatttttctctttatttcaggttcatgtgatccgagaggt

SEQ ID NO: 3903 - DNA, 170 bp, Homo sapiens
tctccatgcagatcagttcctgagactttaaatactgtctctaatagtgacatcagcattcaactagtttttgaggctagaacctttgtagtcattctctgcatatttttctctttatttcaggttcatgtgatccgagaggtagcttccatggcaaaagaaaagcttgg

SEQ ID NO: 3904 - DNA, 170 bp, Homo sapiens
gagactttaaatactgtctctaatagtgacatcagcattcaactagtttttgaggctagaacctttgtagtcattctctgcatatttttctctttatttcaggttcatgtgatccgagaggtagcttccatggcaaaagaaaagcttggagtgtcttgtgaagtcattga

SEQ ID NO: 3905 - DNA, 170 bp, Homo sapiens
tcagcattcaactagtttttgaggctagaacctttgtagtcattctctgcatatttttctctttatttcaggttcatgtgatccgagaggtagcttccatggcaaaagaaaagcttggagtgtcttgtgaagtcattgatctgaggactataataccttgggatgtggac

SEQ ID NO: 3906 - DNA, 170 bp, Homo sapiens
aggctagaacctttgtagtcattctctgcatatttttctctttatttcaggttcatgtgatccgagaggtagcttccatggcaaaagaaaagcttggagtgtcttgtgaagtcattgatctgaggactataataccttgggatgtggacacaatttgtaaggtatgaata

SEQ ID NO: 3907 - DNA, 170 bp, Homo sapiens
ctgcatatttttctctttatttcaggttcatgtgatccgagaggtagcttccatggcaaaagaaaagcttggagtgtcttgtgaagtcattgatctgaggactataataccttgggatgtggacacaatttgtaaggtatgaatataatggtgatagaatgtcatttccc

SEQ ID NO: 3908 - DNA, 170 bp, Homo sapiens
gttcatgtgatccgagaggtagcttccatggcaaaagaaaagcttggagtgtcttgtgaagtcattgatctgaggactataataccttgggatgtggacacaatttgtaaggtatgaatataatggtgatagaatgtcatttccctgaaacctttggccaaatatgttgt

SEQ ID NO: 3909 - DNA, 170 bp, Homo sapiens
tggcaaaagaaaagcttggagtgtcttgtgaagtcattgatctgaggactataataccttgggatgtggacacaatttgtaaggtatgaatataatggtgatagaatgtcatttccctgaaacctttggccaaatatgttgtatatttgcaaataattcttttgaaattg

SEQ ID NO: 3910 - DNA, 170 bp, Homo sapiens
tgtcttgtgaagtcattgatctgaggactataataccttgggatgtggacacaatttgtaaggtatgaatataatggtgatagaatgtcatttccctgaaacctttggccaaatatgttgtatatttgcaaataattcttttgaaattgtgagctatgtgagcattttca

SEQ ID NO: 3911 - DNA, 170 bp, Homo sapiens
ataataccttgggatgtggacacaatttgtaaggtatgaatataatggtgatagaatgtcatttccctgaaacctttggccaaatatgttgtatatttgcaaataattcttttgaaattgtgagctatgtgagcattttcaattgatttaaaacttttaaatttgcagca

SEQ ID NO: 3912 - DNA, 170 bp, Homo sapiens
ttggcatacaattgaattactgatttttacactatttattgaatgtatataatttacttttattactgatttaaaactaccatcatatatataaaatagatattctttttaacatcaggtttttcttttctctttcagtctgtgatcaaaacagggcgactgctaatcag

SEQ ID NO: 3913 - DNA, 170 bp, Homo sapiens
tttttacactatttattgaatgtatataatttacttttattactgatttaaaactaccatcatatatataaaatagatattctttttaacatcaggtttttcttttctctttcagtctgtgatcaaaacagggcgactgctaatcagtcacgaggctcccttgacaggcg

SEQ ID NO: 3914 - DNA, 170 bp, Homo sapiens
taatttacttttattactgatttaaaactaccatcatatatataaaatagatattctttttaacatcaggtttttcttttctctttcagtctgtgatcaaaacagggcgactgctaatcagtcacgaggctcccttgacaggcggctttgcatcggaaatcagctctaca

SEQ ID NO: 3915 - DNA, 170 bp, Homo sapiens
actaccatcatatatataaaatagatattctttttaacatcaggtttttcttttctctttcagtctgtgatcaaaacagggcgactgctaatcagtcacgaggctcccttgacaggcggctttgcatcggaaatcagctctacagttcaggtagagtaatttttggaact

SEQ ID NO: 3916 - DNA, 170 bp, Homo sapiens
attctttttaacatcaggtttttcttttctctttcagtctgtgatcaaaacagggcgactgctaatcagtcacgaggctcccttgacaggcggctttgcatcggaaatcagctctacagttcaggtagagtaatttttggaactgatttcaatgcttgtgcaattccaca

SEQ ID NO: 3917 - DNA, 170 bp, Homo sapiens
tctctttcagtctgtgatcaaaacagggcgactgctaatcagtcacgaggctcccttgacaggcggctttgcatcggaaatcagctctacagttcaggtagagtaatttttggaactgatttcaatgcttgtgcaattccacatgccaattccagaagaaaataaattac

SEQ ID NO: 3918 - DNA, 170 bp, Homo sapiens
gggcgactgctaatcagtcacgaggctcccttgacaggcggctttgcatcggaaatcagctctacagttcaggtagagtaatttttggaactgatttcaatgcttgtgcaattccacatgccaattccagaagaaaataaattacttatcacaatatgtgaaagcataca

SEQ ID NO: 3919 - DNA, 170 bp, Homo sapiens
tcccttgacaggcggctttgcatcggaaatcagctctacagttcaggtagagtaatttttggaactgatttcaatgcttgtgcaattccacatgccaattccagaagaaaataaattacttatcacaatatgtgaaagcatacactttatggaaatgtagtgcatgcttt

SEQ ID NO: 3920 - DNA, 170 bp, Homo sapiens
cggaaatcagctctacagttcaggtagagtaatttttggaactgatttcaatgcttgtgcaattccacatgccaattccagaagaaaataaattacttatcacaatatgtgaaagcatacactttatggaaatgtagtgcatgctttcatatactgtgataagtaaattt

SEQ ID NO: 3921 - DNA, 170 bp, Homo sapiens
aaaaaaaaaaaaaaaaaagtcctattactctgggcacagttggaacaatgcctgtttgaatcaagtccttcctcccctcaaaaaacattgtgattaatgcaaagtacctaactccactgatttctttttccctcactttttaggattatggctgctgttcctcaaaataa

SEQ ID NO: 3922 - DNA, 170 bp, Homo sapiens
tctgggcacagttggaacaatgcctgtttgaatcaagtccttcctcccctcaaaaaacattgtgattaatgcaaagtacctaactccactgatttctttttccctcactttttaggattatggctgctgttcctcaaaataatctacaggagcaactagaacgtcactca

SEQ ID NO: 3923 - DNA, 170 bp, Homo sapiens
tgaatcaagtccttcctcccctcaaaaaacattgtgattaatgcaaagtacctaactccactgatttctttttccctcactttttaggattatggctgctgttcctcaaaataatctacaggagcaactagaacgtcactcagccagaacacttaataataaattaagtc

SEQ ID NO: 3924 - DNA, 170 bp, Homo sapiens
tcaaaaaacattgtgattaatgcaaagtacctaactccactgatttctttttccctcactttttaggattatggctgctgttcctcaaaataatctacaggagcaactagaacgtcactcagccagaacacttaataataaattaagtctttcaaaaccaaaattttcgt

SEQ ID NO: 3925 - DNA, 170 bp, Homo sapiens
agtacctaactccactgatttctttttccctcactttttaggattatggctgctgttcctcaaaataatctacaggagcaactagaacgtcactcagccagaacacttaataataaattaagtctttcaaaaccaaaattttcgtaagtgttttgactggtttgctgtca

SEQ ID NO: 3926 - DNA, 170 bp, Homo sapiens
ttccctcactttttaggattatggctgctgttcctcaaaataatctacaggagcaactagaacgtcactcagccagaacacttaataataaattaagtctttcaaaaccaaaattttcgtaagtgttttgactggtttgctgtcacataggcactaacttaccacattgt

SEQ ID NO: 3927 - DNA, 170 bp, Homo sapiens
gctgttcctcaaaataatctacaggagcaactagaacgtcactcagccagaacacttaataataaattaagtctttcaaaaccaaaattttcgtaagtgttttgactggtttgctgtcacataggcactaacttaccacattgtacacatgagatatcttctctttaaac

SEQ ID NO: 3928 - DNA, 170 bp, Homo sapiens
gcaactagaacgtcactcagccagaacacttaataataaattaagtctttcaaaaccaaaattttcgtaagtgttttgactggtttgctgtcacataggcactaacttaccacattgtacacatgagatatcttctctttaaactcccccattgtacagatgaggaaatg

SEQ ID NO: 3929 - DNA, 170 bp, Homo sapiens
gccagaacacttaataataaattaagtctttcaaaaccaaaattttcgtaagtgttttgactggtttgctgtcacataggcactaacttaccacattgtacacatgagatatcttctctttaaactcccccattgtacagatgaggaaatgaagctgagagattcattga

SEQ ID NO: 3930 - DNA, 170 bp, Homo sapiens
acaggcgtgagccaccgcacccggccttatagaggttttaatacagcttaagttgtgatggaatttgaagaccacagaatcatgaggtgatgtgtttcagtgtttttacatgtctaatgtatttctggcctagatctgtgcaagtaacagactcatttctactctggaga

SEQ ID NO: 3931 - DNA, 170 bp, Homo sapiens
ccggccttatagaggttttaatacagcttaagttgtgatggaatttgaagaccacagaatcatgaggtgatgtgtttcagtgtttttacatgtctaatgtatttctggcctagatctgtgcaagtaacagactcatttctactctggagaatctctatgagaggaagctc

SEQ ID NO: 3932 - DNA, 170 bp, Homo sapiens
aagttgtgatggaatttgaagaccacagaatcatgaggtgatgtgtttcagtgtttttacatgtctaatgtatttctggcctagatctgtgcaagtaacagactcatttctactctggagaatctctatgagaggaagctcttggcacgttttgttattgatgaagcaca

SEQ ID NO: 3933 - DNA, 170 bp, Homo sapiens
ccacagaatcatgaggtgatgtgtttcagtgtttttacatgtctaatgtatttctggcctagatctgtgcaagtaacagactcatttctactctggagaatctctatgagaggaagctcttggcacgttttgttattgatgaagcacattgtgtcagtcaggtaaatact

SEQ ID NO: 3934 - DNA, 170 bp, Homo sapiens
ttcagtgtttttacatgtctaatgtatttctggcctagatctgtgcaagtaacagactcatttctactctggagaatctctatgagaggaagctcttggcacgttttgttattgatgaagcacattgtgtcagtcaggtaaatactgttttttatatccggaaataccga

SEQ ID NO: 3935 - DNA, 170 bp, Homo sapiens
tctggcctagatctgtgcaagtaacagactcatttctactctggagaatctctatgagaggaagctcttggcacgttttgttattgatgaagcacattgtgtcagtcaggtaaatactgttttttatatccggaaataccgataaatacatactaccaacaatatatgta

SEQ ID NO: 3936 - DNA, 170 bp, Homo sapiens
acagactcatttctactctggagaatctctatgagaggaagctcttggcacgttttgttattgatgaagcacattgtgtcagtcaggtaaatactgttttttatatccggaaataccgataaatacatactaccaacaatatatgtatttactgaataaaaacccacact

SEQ ID NO: 3937 - DNA, 170 bp, Homo sapiens
ctctatgagaggaagctcttggcacgttttgttattgatgaagcacattgtgtcagtcaggtaaatactgttttttatatccggaaataccgataaatacatactaccaacaatatatgtatttactgaataaaaacccacactgagtgaacgagtctcctattttactg

SEQ ID NO: 3938 - DNA, 170 bp, Homo sapiens
gttttgttattgatgaagcacattgtgtcagtcaggtaaatactgttttttatatccggaaataccgataaatacatactaccaacaatatatgtatttactgaataaaaacccacactgagtgaacgagtctcctattttactgaagaataaggtagttcttaatacat

SEQ ID NO: 3939 - DNA, 170 bp, Homo sapiens
actgaataaaaacccacactgagtgaacgagtctcctattttactgaagaataaggtagttcttaatacattgagcagtgttggctttttatagaaggaagctccaagtagtctgaaaagcagtatttttttttccaactagtggggacatgattttcgtcaagattaca

SEQ ID NO: 3940 - DNA, 170 bp, Homo sapiens
gtgaacgagtctcctattttactgaagaataaggtagttcttaatacattgagcagtgttggctttttatagaaggaagctccaagtagtctgaaaagcagtatttttttttccaactagtggggacatgattttcgtcaagattacaaaagaatgaatatgcttcgcca

SEQ ID NO: 3941 - DNA, 170 bp, Homo sapiens
ggtacagaaggacatcctgactcagctgaagattctcagacctcaggtgtaagttgttgcacgtcacgtatttgagaaccctggggcagtgactgccagagctgctacatgttagaatcacctgtggcgctttaacgccaccaccccacccccaccccacccccatgccc

SEQ ID NO: 3942 - DNA, 170 bp, Homo sapiens
tgaagaataaggtagttcttaatacattgagcagtgttggctttttatagaaggaagctccaagtagtctgaaaagcagtatttttttttccaactagtggggacatgattttcgtcaagattacaaaagaatgaatatgcttcgccagaagtttccttctgttccggtg

SEQ ID NO: 3943 - DNA, 170 bp, Homo sapiens
tgagcagtgttggctttttatagaaggaagctccaagtagtctgaaaagcagtatttttttttccaactagtggggacatgattttcgtcaagattacaaaagaatgaatatgcttcgccagaagtttccttctgttccggtgatggctcttacggccacagctaatccc

SEQ ID NO: 3944 - DNA, 170 bp, Homo sapiens
agctccaagtagtctgaaaagcagtatttttttttccaactagtggggacatgattttcgtcaagattacaaaagaatgaatatgcttcgccagaagtttccttctgttccggtgatggctcttacggccacagctaatcccagggtacagaaggacatcctgactcagc

SEQ ID NO: 3945 - DNA, 170 bp, Homo sapiens
agtatttttttttccaactagtggggacatgattttcgtcaagattacaaaagaatgaatatgcttcgccagaagtttccttctgttccggtgatggctcttacggccacagctaatcccagggtacagaaggacatcctgactcagctgaagattctcagacctcaggt

SEQ ID NO: 3946 - DNA, 170 bp, Homo sapiens
ggggacatgattttcgtcaagattacaaaagaatgaatatgcttcgccagaagtttccttctgttccggtgatggctcttacggccacagctaatcccagggtacagaaggacatcctgactcagctgaagattctcagacctcaggtgtaagttgttgcacgtcacgta

SEQ ID NO: 3947 - DNA, 170 bp, Homo sapiens
aaagaatgaatatgcttcgccagaagtttccttctgttccggtgatggctcttacggccacagctaatcccagggtacagaaggacatcctgactcagctgaagattctcagacctcaggtgtaagttgttgcacgtcacgtatttgagaaccctggggcagtgactgcc

SEQ ID NO: 3948 - DNA, 170 bp, Homo sapiens
ccttctgttccggtgatggctcttacggccacagctaatcccagggtacagaaggacatcctgactcagctgaagattctcagacctcaggtgtaagttgttgcacgtcacgtatttgagaaccctggggcagtgactgccagagctgctacatgttagaatcacctgtg

SEQ ID NO: 3949 - DNA, 170 bp, Homo sapiens
tacggccacagctaatcccagggtacagaaggacatcctgactcagctgaagattctcagacctcaggtgtaagttgttgcacgtcacgtatttgagaaccctggggcagtgactgccagagctgctacatgttagaatcacctgtggcgctttaacgccaccaccccac

SEQ ID NO: 3950 - DNA, 170 bp, Homo sapiens
ggctccaactcctaataccatcacactgggggttaggattttaggggggacacatgtagtctataacaatacctaaagtcatattttctcataataactaaattttatgtttgggacttttttaggtttagcatgagctttaacagacataatctgaaatactatgtatt

SEQ ID NO: 3951 - DNA, 170 bp, Homo sapiens
actgggggttaggattttaggggggacacatgtagtctataacaatacctaaagtcatattttctcataataactaaattttatgtttgggacttttttaggtttagcatgagctttaacagacataatctgaaatactatgtattaccgaaaaagcctaaaaaggtggc

SEQ ID NO: 3952 - DNA, 170 bp, Homo sapiens
ggacacatgtagtctataacaatacctaaagtcatattttctcataataactaaattttatgtttgggacttttttaggtttagcatgagctttaacagacataatctgaaatactatgtattaccgaaaaagcctaaaaaggtggcatttgattgcctagaatggatca

SEQ ID NO: 3953 - DNA, 170 bp, Homo sapiens
acctaaagtcatattttctcataataactaaattttatgtttgggacttttttaggtttagcatgagctttaacagacataatctgaaatactatgtattaccgaaaaagcctaaaaaggtggcatttgattgcctagaatggatcagaaagcaccacccatgtgagtac

SEQ ID NO: 3954 - DNA, 170 bp, Homo sapiens
ttatgtttgggacttttttaggtttagcatgagctttaacagacataatctgaaatactatgtattaccgaaaaagcctaaaaaggtggcatttgattgcctagaatggatcagaaagcaccacccatgtgagtacagccatgtgattagctgtctagaagtaacaaatg

SEQ ID NO: 3955 - DNA, 170 bp, Homo sapiens
aggtttagcatgagctttaacagacataatctgaaatactatgtattaccgaaaaagcctaaaaaggtggcatttgattgcctagaatggatcagaaagcaccacccatgtgagtacagccatgtgattagctgtctagaagtaacaaatgtctttttagtaccacaata

SEQ ID NO: 3956 - DNA, 170 bp, Homo sapiens
taatctgaaatactatgtattaccgaaaaagcctaaaaaggtggcatttgattgcctagaatggatcagaaagcaccacccatgtgagtacagccatgtgattagctgtctagaagtaacaaatgtctttttagtaccacaataagatatataaaattgcatattaaaca

SEQ ID NO: 3957 - DNA, 170 bp, Homo sapiens
aaaaagcctaaaaaggtggcatttgattgcctagaatggatcagaaagcaccacccatgtgagtacagccatgtgattagctgtctagaagtaacaaatgtctttttagtaccacaataagatatataaaattgcatattaaacattcctttttgcattatgacagcact

SEQ ID NO: 3958 - DNA, 170 bp, Homo sapiens
gattgcctagaatggatcagaaagcaccacccatgtgagtacagccatgtgattagctgtctagaagtaacaaatgtctttttagtaccacaataagatatataaaattgcatattaaacattcctttttgcattatgacagcactaacttgctctttatagagcagact

SEQ ID NO: 3959 - DNA, 170 bp, Homo sapiens
cacgtgtgtggtcttccagcagtataagaacactacgggagatctatttatggttcatatatttctgaaaatgtagtgtaaattgtgtttttgtttatgttaaaaattcttgtttctcagtactcttggtttcttggcagatgattcagggataatttactgcctctcca

SEQ ID NO: 3960 - DNA, 170 bp, Homo sapiens
aagaacactacgggagatctatttatggttcatatatttctgaaaatgtagtgtaaattgtgtttttgtttatgttaaaaattcttgtttctcagtactcttggtttcttggcagatgattcagggataatttactgcctctccaggcgagaatgtgacaccatggctga

SEQ ID NO: 3961 - DNA, 170 bp, Homo sapiens
tgccagagatgaagtgcagcagaagtggattaatcaggatggctgtcaggtaacatttttaaagataaacaaataatagaaataatcttttatagcatataaccaaacatgcacatgtagaatgcaaactgtttttaccttgaaggtagtaaacatcaaaataagactga

SEQ ID NO: 3962 - DNA, 170 bp, Homo sapiens
agtggattaatcaggatggctgtcaggtaacatttttaaagataaacaaataatagaaataatcttttatagcatataaccaaacatgcacatgtagaatgcaaactgtttttaccttgaaggtagtaaacatcaaaataagactgaaatttaaaaaacagattttcttt

SEQ ID NO: 3963 - DNA, 170 bp, Homo sapiens
tatggttcatatatttctgaaaatgtagtgtaaattgtgtttttgtttatgttaaaaattcttgtttctcagtactcttggtttcttggcagatgattcagggataatttactgcctctccaggcgagaatgtgacaccatggctgacacgttacagagagatgggctcg

SEQ ID NO: 3964 - DNA, 170 bp, Homo sapiens
tgtagtgtaaattgtgtttttgtttatgttaaaaattcttgtttctcagtactcttggtttcttggcagatgattcagggataatttactgcctctccaggcgagaatgtgacaccatggctgacacgttacagagagatgggctcgctgctcttgcttaccatgctggc

SEQ ID NO: 3965 - DNA, 170 bp, Homo sapiens
tgttaaaaattcttgtttctcagtactcttggtttcttggcagatgattcagggataatttactgcctctccaggcgagaatgtgacaccatggctgacacgttacagagagatgggctcgctgctcttgcttaccatgctggcctcagtgattctgccagagatgaagt

SEQ ID NO: 3966 - DNA, 170 bp, Homo sapiens
tggtttcttggcagatgattcagggataatttactgcctctccaggcgagaatgtgacaccatggctgacacgttacagagagatgggctcgctgctcttgcttaccatgctggcctcagtgattctgccagagatgaagtgcagcagaagtggattaatcaggatggct

SEQ ID NO: 3967 - DNA, 170 bp, Homo sapiens
agggataatttactgcctctccaggcgagaatgtgacaccatggctgacacgttacagagagatgggctcgctgctcttgcttaccatgctggcctcagtgattctgccagagatgaagtgcagcagaagtggattaatcaggatggctgtcaggtaacatttttaaaga

SEQ ID NO: 3968 - DNA, 170 bp, Homo sapiens
tgtgacaccatggctgacacgttacagagagatgggctcgctgctcttgcttaccatgctggcctcagtgattctgccagagatgaagtgcagcagaagtggattaatcaggatggctgtcaggtaacatttttaaagataaacaaataatagaaataatcttttatagc

SEQ ID NO: 3969 - DNA, 170 bp, Homo sapiens
acagagagatgggctcgctgctcttgcttaccatgctggcctcagtgattctgccagagatgaagtgcagcagaagtggattaatcaggatggctgtcaggtaacatttttaaagataaacaaataatagaaataatcttttatagcatataaccaaacatgcacatgta

SEQ ID NO: 3970 - DNA, 170 bp, Homo sapiens
tgcttaccatgctggcctcagtgattctgccagagatgaagtgcagcagaagtggattaatcaggatggctgtcaggtaacatttttaaagataaacaaataatagaaataatcttttatagcatataaccaaacatgcacatgtagaatgcaaactgtttttaccttga

SEQ ID NO: 3971 - DNA, 170 bp, Homo sapiens
tggaccaagttaagatattaggttgttatgtagtgtgcattttaaagtaaaacaaatgatagagcttttagaagcatctattatgaaaatgttccttcaagtctgtgccttatgaatctaataagcttttgcttttatatcaggttatctgtgctacaattgcatttgga

SEQ ID NO: 3972 - DNA, 170 bp, Homo sapiens
tgttatgtagtgtgcattttaaagtaaaacaaatgatagagcttttagaagcatctattatgaaaatgttccttcaagtctgtgccttatgaatctaataagcttttgcttttatatcaggttatctgtgctacaattgcatttggaatggggattgacaaaccggacgt

SEQ ID NO: 3973 - DNA, 170 bp, Homo sapiens
ggcagagctggaagagatggggaaatatctcactgcctgcttttctatacctatcatgatgtgaccagactgaaaagacttataatgagtaagctgggctccattgtagagacattctgtcatcttcagcctcatgatagtagtctactcctgctattgtggtacttctg

SEQ ID NO: 3974 - DNA, 170 bp, Homo sapiens
aaatatctcactgcctgcttttctatacctatcatgatgtgaccagactgaaaagacttataatgagtaagctgggctccattgtagagacattctgtcatcttcagcctcatgatagtagtctactcctgctattgtggtacttctggtccagttttccttaaataatc

SEQ ID NO: 3975 - DNA, 170 bp, Homo sapiens
tcatgatgtgaccagactgaaaagacttataatgagtaagctgggctccattgtagagacattctgtcatcttcagcctcatgatagtagtctactcctgctattgtggtacttctggtccagttttccttaaataatcgtagaaaaatagaggagtttatacagattgg

SEQ ID NO: 3976 - DNA, 170 bp, Homo sapiens
aaatgatagagcttttagaagcatctattatgaaaatgttccttcaagtctgtgccttatgaatctaataagcttttgcttttatatcaggttatctgtgctacaattgcatttggaatggggattgacaaaccggacgtgcgatttgtgattcatgcatctctccctaa

SEQ ID NO: 3977 - DNA, 170 bp, Homo sapiens
gcatctattatgaaaatgttccttcaagtctgtgccttatgaatctaataagcttttgcttttatatcaggttatctgtgctacaattgcatttggaatggggattgacaaaccggacgtgcgatttgtgattcatgcatctctccctaaatctgtggagggttactacc

SEQ ID NO: 3978 - DNA, 170 bp, Homo sapiens
aagtctgtgccttatgaatctaataagcttttgcttttatatcaggttatctgtgctacaattgcatttggaatggggattgacaaaccggacgtgcgatttgtgattcatgcatctctccctaaatctgtggagggttactaccaagaatctggcagagctggaagaga

SEQ ID NO: 3979 - DNA, 170 bp, Homo sapiens
cttttatatcaggttatctgtgctacaattgcatttggaatggggattgacaaaccggacgtgcgatttgtgattcatgcatctctccctaaatctgtggagggttactaccaagaatctggcagagctggaagagatggggaaatatctcactgcctgcttttctatac

SEQ ID NO: 3980 - DNA, 170 bp, Homo sapiens
tgctacaattgcatttggaatggggattgacaaaccggacgtgcgatttgtgattcatgcatctctccctaaatctgtggagggttactaccaagaatctggcagagctggaagagatggggaaatatctcactgcctgcttttctatacctatcatgatgtgaccagac

SEQ ID NO: 3981 - DNA, 170 bp, Homo sapiens
acaaaccggacgtgcgatttgtgattcatgcatctctccctaaatctgtggagggttactaccaagaatctggcagagctggaagagatggggaaatatctcactgcctgcttttctatacctatcatgatgtgaccagactgaaaagacttataatgagtaagctgggc

SEQ ID NO: 3982 - DNA, 170 bp, Homo sapiens
tgattcatgcatctctccctaaatctgtggagggttactaccaagaatctggcagagctggaagagatggggaaatatctcactgcctgcttttctatacctatcatgatgtgaccagactgaaaagacttataatgagtaagctgggctccattgtagagacattctgt

SEQ ID NO: 3983 - DNA, 170 bp, Homo sapiens
tgtggagggttactaccaagaatctggcagagctggaagagatggggaaatatctcactgcctgcttttctatacctatcatgatgtgaccagactgaaaagacttataatgagtaagctgggctccattgtagagacattctgtcatcttcagcctcatgatagtagtc

SEQ ID NO: 3984 - DNA, 170 bp, Homo sapiens
tgccatgttgacaatgctgttaacagtaattttcttatttaatatttaaagttatatgaatctattctaaatatttctatgatatgctctatttttcccctataagtatgtcttactatagtcttcatctcttttagtggaaaaagatggaaaccatcatacaagagaaa

SEQ ID NO: 3985 - DNA, 170 bp, Homo sapiens
cagtaattttcttatttaatatttaaagttatatgaatctattctaaatatttctatgatatgctctatttttcccctataagtatgtcttactatagtcttcatctcttttagtggaaaaagatggaaaccatcatacaagagaaactcacttcaataatttgtatagc

SEQ ID NO: 3986 - DNA, 170 bp, Homo sapiens
actttggtgaaaatggatttaatcctgatttttgtaagaaacacccagatgtttcttgtgataattgctgtaaaacaaaggtaaaaaaagaagttttaaaattctttataattaaattttttttctcttactttaaaaatgtagatacaaattagattgcaaaaggtggt

SEQ ID NO: 3987 - DNA, 170 bp, Homo sapiens
tcctgatttttgtaagaaacacccagatgtttcttgtgataattgctgtaaaacaaaggtaaaaaaagaagttttaaaattctttataattaaattttttttctcttactttaaaaatgtagatacaaattagattgcaaaaggtggtctccgacagattaacaggggaa

SEQ ID NO: 3988 - DNA, 170 bp, Homo sapiens
gtttcttgtgataattgctgtaaaacaaaggtaaaaaaagaagttttaaaattctttataattaaattttttttctcttactttaaaaatgtagatacaaattagattgcaaaaggtggtctccgacagattaacaggggaaagacagcttccttccagtagtaatttgg

SEQ ID NO: 3989 - DNA, 170 bp, Homo sapiens
ttaaagttatatgaatctattctaaatatttctatgatatgctctatttttcccctataagtatgtcttactatagtcttcatctcttttagtggaaaaagatggaaaccatcatacaagagaaactcacttcaataatttgtatagcatggtacattactgtgaaaata

SEQ ID NO: 3990 - DNA, 170 bp, Homo sapiens
atttctatgatatgctctatttttcccctataagtatgtcttactatagtcttcatctcttttagtggaaaaagatggaaaccatcatacaagagaaactcacttcaataatttgtatagcatggtacattactgtgaaaatataacggaatgcaggagaatacagcttt

SEQ ID NO: 3991 - DNA, 170 bp, Homo sapiens
tcccctataagtatgtcttactatagtcttcatctcttttagtggaaaaagatggaaaccatcatacaagagaaactcacttcaataatttgtatagcatggtacattactgtgaaaatataacggaatgcaggagaatacagcttttggcctactttggtgaaaatgga

SEQ ID NO: 3992 - DNA, 170 bp, Homo sapiens
tcatctcttttagtggaaaaagatggaaaccatcatacaagagaaactcacttcaataatttgtatagcatggtacattactgtgaaaatataacggaatgcaggagaatacagcttttggcctactttggtgaaaatggatttaatcctgatttttgtaagaaacaccc

SEQ ID NO: 3993 - DNA, 170 bp, Homo sapiens
ggaaaccatcatacaagagaaactcacttcaataatttgtatagcatggtacattactgtgaaaatataacggaatgcaggagaatacagcttttggcctactttggtgaaaatggatttaatcctgatttttgtaagaaacacccagatgtttcttgtgataattgctg

SEQ ID NO: 3994 - DNA, 170 bp, Homo sapiens
cacttcaataatttgtatagcatggtacattactgtgaaaatataacggaatgcaggagaatacagcttttggcctactttggtgaaaatggatttaatcctgatttttgtaagaaacacccagatgtttcttgtgataattgctgtaaaacaaaggtaaaaaaagaagt

SEQ ID NO: 3995 - DNA, 170 bp, Homo sapiens
acattactgtgaaaatataacggaatgcaggagaatacagcttttggcctactttggtgaaaatggatttaatcctgatttttgtaagaaacacccagatgtttcttgtgataattgctgtaaaacaaaggtaaaaaaagaagttttaaaattctttataattaaatttt

SEQ ID NO: 3996 - DNA, 170 bp, Homo sapiens
tgcaggagaatacagcttttggcctactttggtgaaaatggatttaatcctgatttttgtaagaaacacccagatgtttcttgtgataattgctgtaaaacaaaggtaaaaaaagaagttttaaaattctttataattaaattttttttctcttactttaaaaatgtaga

SEQ ID NO: 3997 - DNA, 170 bp, Homo sapiens
aaatttccgtaggttttggtctcggtattggtctggaaatgggttatgatgaatctactatagttaatattaaaccctagtaatctaggcattgttaccttaattatagcagaaagtattctctttttattcataggattataaaacaagagatgtgactgacgatgtga

SEQ ID NO: 3998 - DNA, 170 bp, Homo sapiens
tggtctggaaatgggttatgatgaatctactatagttaatattaaaccctagtaatctaggcattgttaccttaattatagcagaaagtattctctttttattcataggattataaaacaagagatgtgactgacgatgtgaaaagtattgtaagatttgttcaagaaca

SEQ ID NO: 3999 - DNA, 170 bp, Homo sapiens
actatgaatatgctggtcgacattttcttgggtaagtcatctgttttgaatgtttgagttacttcaattgaaattgaacatctaaagaatttattacaagtacatagaaaaactttttgtctattttcttataaaacttgagtttctgaataaaacttttaagtaacaaa

SEQ ID NO: 4000 - DNA, 170 bp, Homo sapiens
tgaatctactatagttaatattaaaccctagtaatctaggcattgttaccttaattatagcagaaagtattctctttttattcataggattataaaacaagagatgtgactgacgatgtgaaaagtattgtaagatttgttcaagaacatagttcatcacaaggaatgag

SEQ ID NO: 4001 - DNA, 170 bp, Homo sapiens
tagtaatctaggcattgttaccttaattatagcagaaagtattctctttttattcataggattataaaacaagagatgtgactgacgatgtgaaaagtattgtaagatttgttcaagaacatagttcatcacaaggaatgagaaatataaaacatgtaggtccttctgga

SEQ ID NO: 4002 - DNA, 170 bp, Homo sapiens
ttatagcagaaagtattctctttttattcataggattataaaacaagagatgtgactgacgatgtgaaaagtattgtaagatttgttcaagaacatagttcatcacaaggaatgagaaatataaaacatgtaggtccttctggaagatttactatgaatatgctggtcga

SEQ ID NO: 4003 - DNA, 170 bp, Homo sapiens
ctttttattcataggattataaaacaagagatgtgactgacgatgtgaaaagtattgtaagatttgttcaagaacatagttcatcacaaggaatgagaaatataaaacatgtaggtccttctggaagatttactatgaatatgctggtcgacattttcttgggtaagtca

SEQ ID NO: 4004 - DNA, 170 bp, Homo sapiens
tgtgactgacgatgtgaaaagtattgtaagatttgttcaagaacatagttcatcacaaggaatgagaaatataaaacatgtaggtccttctggaagatttactatgaatatgctggtcgacattttcttgggtaagtcatctgttttgaatgtttgagttacttcaattg

SEQ ID NO: 4005 - DNA, 170 bp, Homo sapiens
ttgtaagatttgttcaagaacatagttcatcacaaggaatgagaaatataaaacatgtaggtccttctggaagatttactatgaatatgctggtcgacattttcttgggtaagtcatctgttttgaatgtttgagttacttcaattgaaattgaacatctaaagaattta

SEQ ID NO: 4006 - DNA, 170 bp, Homo sapiens
tcatcacaaggaatgagaaatataaaacatgtaggtccttctggaagatttactatgaatatgctggtcgacattttcttgggtaagtcatctgttttgaatgtttgagttacttcaattgaaattgaacatctaaagaatttattacaagtacatagaaaaactttttg

SEQ ID NO: 4007 - DNA, 170 bp, Homo sapiens
acatgtaggtccttctggaagatttactatgaatatgctggtcgacattttcttgggtaagtcatctgttttgaatgtttgagttacttcaattgaaattgaacatctaaagaatttattacaagtacatagaaaaactttttgtctattttcttataaaacttgagttt

SEQ ID NO: 4008 - DNA, 170 bp, Homo sapiens
ctcatttaacagaaatgagtgtctgtgccggggtttgtgatctattccatctgtccaaacctgtccataaatgactttttagcctcttctatttgagggtgatgatatacgtacatttactcatcttacttcctgtatcttcttatcagggagtaagagtgcaaaaatcc

SEQ ID NO: 4009 - DNA, 170 bp, Homo sapiens
gccggggtttgtgatctattccatctgtccaaacctgtccataaatgactttttagcctcttctatttgagggtgatgatatacgtacatttactcatcttacttcctgtatcttcttatcagggagtaagagtgcaaaaatccagtcaggtatatttggaaaaggatct

SEQ ID NO: 4010 - DNA, 170 bp, Homo sapiens
tttggatgaagacttatatatcaatgccaatgaccaggcgatcgcttatgtgatgctcggaaataaagcccaaactgtactaaatggcaatttaaaggtatagtatttttcatgtttattttattatctcacaatgagtgaaccaaaatatattattgtgaagtatagtg

SEQ ID NO: 4011 - DNA, 170 bp, Homo sapiens
gccaatgaccaggcgatcgcttatgtgatgctcggaaataaagcccaaactgtactaaatggcaatttaaaggtatagtatttttcatgtttattttattatctcacaatgagtgaaccaaaatatattattgtgaagtatagtgtctttgtccaagcttatagatactg

SEQ ID NO: 4012 - DNA, 170 bp, Homo sapiens
gtgatgctcggaaataaagcccaaactgtactaaatggcaatttaaaggtatagtatttttcatgtttattttattatctcacaatgagtgaaccaaaatatattattgtgaagtatagtgtctttgtccaagcttatagatactgaatttatatatactgttctatacg

SEQ ID NO: 4013 - DNA, 170 bp, Homo sapiens
tgtactaaatggcaatttaaaggtatagtatttttcatgtttattttattatctcacaatgagtgaaccaaaatatattattgtgaagtatagtgtctttgtccaagcttatagatactgaatttatatatactgttctatacgaacatattctgtttttcttaaattgg

SEQ ID NO: 4014 - DNA, 170 bp, Homo sapiens
tctgtccaaacctgtccataaatgactttttagcctcttctatttgagggtgatgatatacgtacatttactcatcttacttcctgtatcttcttatcagggagtaagagtgcaaaaatccagtcaggtatatttggaaaaggatctgcttattcacgacacaatgccga

SEQ ID NO: 4015 - DNA, 170 bp, Homo sapiens
ttttagcctcttctatttgagggtgatgatatacgtacatttactcatcttacttcctgtatcttcttatcagggagtaagagtgcaaaaatccagtcaggtatatttggaaaaggatctgcttattcacgacacaatgccgaaagactttttaaaaagctgatacttga

SEQ ID NO: 4016 - DNA, 170 bp, Homo sapiens
ggtgatgatatacgtacatttactcatcttacttcctgtatcttcttatcagggagtaagagtgcaaaaatccagtcaggtatatttggaaaaggatctgcttattcacgacacaatgccgaaagactttttaaaaagctgatacttgacaagattttggatgaagactt

SEQ ID NO: 4017 - DNA, 170 bp, Homo sapiens
tcttacttcctgtatcttcttatcagggagtaagagtgcaaaaatccagtcaggtatatttggaaaaggatctgcttattcacgacacaatgccgaaagactttttaaaaagctgatacttgacaagattttggatgaagacttatatatcaatgccaatgaccaggcga

SEQ ID NO: 4018 - DNA, 170 bp, Homo sapiens
gggagtaagagtgcaaaaatccagtcaggtatatttggaaaaggatctgcttattcacgacacaatgccgaaagactttttaaaaagctgatacttgacaagattttggatgaagacttatatatcaatgccaatgaccaggcgatcgcttatgtgatgctcggaaataa

SEQ ID NO: 4019 - DNA, 170 bp, Homo sapiens
tcaggtatatttggaaaaggatctgcttattcacgacacaatgccgaaagactttttaaaaagctgatacttgacaagattttggatgaagacttatatatcaatgccaatgaccaggcgatcgcttatgtgatgctcggaaataaagcccaaactgtactaaatggcaa

SEQ ID NO: 4020 - DNA, 170 bp, Homo sapiens
cacgacacaatgccgaaagactttttaaaaagctgatacttgacaagattttggatgaagacttatatatcaatgccaatgaccaggcgatcgcttatgtgatgctcggaaataaagcccaaactgtactaaatggcaatttaaaggtatagtatttttcatgtttattt

SEQ ID NO: 4021 - DNA, 170 bp, Homo sapiens
tttaaaaagctgatacttgacaagattttggatgaagacttatatatcaatgccaatgaccaggcgatcgcttatgtgatgctcggaaataaagcccaaactgtactaaatggcaatttaaaggtatagtatttttcatgtttattttattatctcacaatgagtgaacc

SEQ ID NO: 4022 - DNA, 170 bp, Homo sapiens
agcccctgttcccagtgggctcactatctgcatgacagaatagaattgccccccaaaaatgcaattaagcattaaataaagcccctgtatgggtacaagtgcacatatacccactcctatgatttgtttctctctcataaaggtagactttatggaaacagaaaattcca

SEQ ID NO: 4023 - DNA, 170 bp, Homo sapiens
actatctgcatgacagaatagaattgccccccaaaaatgcaattaagcattaaataaagcccctgtatgggtacaagtgcacatatacccactcctatgatttgtttctctctcataaaggtagactttatggaaacagaaaattccagcagtgtgaaaaaacaaaaagc

SEQ ID NO: 4024 - DNA, 170 bp, Homo sapiens
aacttacagaagtctgcaaatctctggggaaagtttttggtgtccattacttcaatatttttaataccgtcactctcaagaagcttgcaggtgggtacacatgtatcctttgttacgtggcacagattaataggccgaaagttaatcttgctagggaactccttaagtga

SEQ ID NO: 4025 - DNA, 170 bp, Homo sapiens
gggaaagtttttggtgtccattacttcaatatttttaataccgtcactctcaagaagcttgcaggtgggtacacatgtatcctttgttacgtggcacagattaataggccgaaagttaatcttgctagggaactccttaagtgataaatatatctcagtggtttgtttct

SEQ ID NO: 4026 - DNA, 170 bp, Homo sapiens
tcaatatttttaataccgtcactctcaagaagcttgcaggtgggtacacatgtatcctttgttacgtggcacagattaataggccgaaagttaatcttgctagggaactccttaagtgataaatatatctcagtggtttgtttctttttggggtttgttttgagacgggg

SEQ ID NO: 4027 - DNA, 170 bp, Homo sapiens
ccccccaaaaatgcaattaagcattaaataaagcccctgtatgggtacaagtgcacatatacccactcctatgatttgtttctctctcataaaggtagactttatggaaacagaaaattccagcagtgtgaaaaaacaaaaagcgttagtagcaaaagtgtctcagaggg

SEQ ID NO: 4028 - DNA, 170 bp, Homo sapiens
taaagcccctgtatgggtacaagtgcacatatacccactcctatgatttgtttctctctcataaaggtagactttatggaaacagaaaattccagcagtgtgaaaaaacaaaaagcgttagtagcaaaagtgtctcagagggaagagatggttaaaaaatgtcttggaga

SEQ ID NO: 4029 - DNA, 170 bp, Homo sapiens
gtgcacatatacccactcctatgatttgtttctctctcataaaggtagactttatggaaacagaaaattccagcagtgtgaaaaaacaaaaagcgttagtagcaaaagtgtctcagagggaagagatggttaaaaaatgtcttggagaacttacagaagtctgcaaatct

SEQ ID NO: 4030 - DNA, 170 bp, Homo sapiens
gatttgtttctctctcataaaggtagactttatggaaacagaaaattccagcagtgtgaaaaaacaaaaagcgttagtagcaaaagtgtctcagagggaagagatggttaaaaaatgtcttggagaacttacagaagtctgcaaatctctggggaaagtttttggtgtcc

SEQ ID NO: 4031 - DNA, 170 bp, Homo sapiens
actttatggaaacagaaaattccagcagtgtgaaaaaacaaaaagcgttagtagcaaaagtgtctcagagggaagagatggttaaaaaatgtcttggagaacttacagaagtctgcaaatctctggggaaagtttttggtgtccattacttcaatatttttaataccgtc

SEQ ID NO: 4032 - DNA, 170 bp, Homo sapiens
gcagtgtgaaaaaacaaaaagcgttagtagcaaaagtgtctcagagggaagagatggttaaaaaatgtcttggagaacttacagaagtctgcaaatctctggggaaagtttttggtgtccattacttcaatatttttaataccgtcactctcaagaagcttgcaggtggg

SEQ ID NO: 4033 - DNA, 170 bp, Homo sapiens
agcaaaagtgtctcagagggaagagatggttaaaaaatgtcttggagaacttacagaagtctgcaaatctctggggaaagtttttggtgtccattacttcaatatttttaataccgtcactctcaagaagcttgcaggtgggtacacatgtatcctttgttacgtggcac

SEQ ID NO: 4034 - DNA, 170 bp, Homo sapiens
agatggttaaaaaatgtcttggagaacttacagaagtctgcaaatctctggggaaagtttttggtgtccattacttcaatatttttaataccgtcactctcaagaagcttgcaggtgggtacacatgtatcctttgttacgtggcacagattaataggccgaaagttaat

SEQ ID NO: 4035 - DNA, 170 bp, Homo sapiens
tgccttttacaaaattggcctgtgttcccagtaccctgcagttagttggcacttagcagacgtgtgctgaatgcgtgaatgagcctgaattcagtgggttttctatgggtgataatttaaattcctaattttatgcctttgcacagaatctttatcttctgatcctgagg

SEQ ID NO: 4036 - DNA, 170 bp, Homo sapiens
cagtaccctgcagttagttggcacttagcagacgtgtgctgaatgcgtgaatgagcctgaattcagtgggttttctatgggtgataatttaaattcctaattttatgcctttgcacagaatctttatcttctgatcctgaggttttgcttcaaattgatggtgttactga

SEQ ID NO: 4037 - DNA, 170 bp, Homo sapiens
acttagcagacgtgtgctgaatgcgtgaatgagcctgaattcagtgggttttctatgggtgataatttaaattcctaattttatgcctttgcacagaatctttatcttctgatcctgaggttttgcttcaaattgatggtgttactgaagacaaactggaaaaatatggt

SEQ ID NO: 4038 - DNA, 170 bp, Homo sapiens
tgaatgagcctgaattcagtgggttttctatgggtgataatttaaattcctaattttatgcctttgcacagaatctttatcttctgatcctgaggttttgcttcaaattgatggtgttactgaagacaaactggaaaaatatggtgcggaagtgatttcagtattacaga

SEQ ID NO: 4039 - DNA, 170 bp, Homo sapiens
ggttttctatgggtgataatttaaattcctaattttatgcctttgcacagaatctttatcttctgatcctgaggttttgcttcaaattgatggtgttactgaagacaaactggaaaaatatggtgcggaagtgatttcagtattacagaaatactctgaatggacatcgc

SEQ ID NO: 4040 - DNA, 170 bp, Homo sapiens
ttcctaattttatgcctttgcacagaatctttatcttctgatcctgaggttttgcttcaaattgatggtgttactgaagacaaactggaaaaatatggtgcggaagtgatttcagtattacagaaatactctgaatggacatcgccaggttagtacacagccatgtgtgt

SEQ ID NO: 4041 - DNA, 170 bp, Homo sapiens
tctttatcttctgatcctgaggttttgcttcaaattgatggtgttactgaagacaaactggaaaaatatggtgcggaagtgatttcagtattacagaaatactctgaatggacatcgccaggttagtacacagccatgtgtgttctctaaaagcctgtttaatgtgaagc

SEQ ID NO: 4042 - DNA, 170 bp, Homo sapiens
tgcttcaaattgatggtgttactgaagacaaactggaaaaatatggtgcggaagtgatttcagtattacagaaatactctgaatggacatcgccaggttagtacacagccatgtgtgttctctaaaagcctgtttaatgtgaagcgacgcgtctcactgaattagaagga

SEQ ID NO: 4043 - DNA, 170 bp, Homo sapiens
tgaagacaaactggaaaaatatggtgcggaagtgatttcagtattacagaaatactctgaatggacatcgccaggttagtacacagccatgtgtgttctctaaaagcctgtttaatgtgaagcgacgcgtctcactgaattagaaggatgcagttgtgtgaatgcttcct

SEQ ID NO: 4044 - DNA, 170 bp, Homo sapiens
gcggaagtgatttcagtattacagaaatactctgaatggacatcgccaggttagtacacagccatgtgtgttctctaaaagcctgtttaatgtgaagcgacgcgtctcactgaattagaaggatgcagttgtgtgaatgcttcctacacctcgtcacactgacatccaag

SEQ ID NO: 4045 - DNA, 170 bp, Homo sapiens
gagatggattctttgctcagttgggatacaattaatgtaacctgtgtgaattagtttaaaaaattagttttgtagagttggggggtttcttaaaatggatccatctaatctagtttttccattatttttcagaggtttcacttttaaaaagaaaacatcttcagataaca

SEQ ID NO: 4046 - DNA, 170 bp, Homo sapiens
ggatacaattaatgtaacctgtgtgaattagtttaaaaaattagttttgtagagttggggggtttcttaaaatggatccatctaatctagtttttccattatttttcagaggtttcacttttaaaaagaaaacatcttcagataacaatgtatctgtaactaatgtgtca

SEQ ID NO: 4047 - DNA, 170 bp, Homo sapiens
ccttcagtgaacctctacccaacaccacaaatcagcaaagggtcaaggacttctttaaaaatgctccagcaggacaggaaacacagagaggtggatcaaaatcattattgccagatttcttgcagactccgaaggaagttgtatgcactacccaaaacacaccaactgta

SEQ ID NO: 4048 - DNA, 170 bp, Homo sapiens
ccacaaatcagcaaagggtcaaggacttctttaaaaatgctccagcaggacaggaaacacagagaggtggatcaaaatcattattgccagatttcttgcagactccgaaggaagttgtatgcactacccaaaacacaccaactgtaaagaaatcccgggatactgctctc

SEQ ID NO: 4049 - DNA, 170 bp, Homo sapiens
ctttaaaaatgctccagcaggacaggaaacacagagaggtggatcaaaatcattattgccagatttcttgcagactccgaaggaagttgtatgcactacccaaaacacaccaactgtaaagaaatcccgggatactgctctcaagaaattagaatttagttcttcaccag

SEQ ID NO: 4050 - DNA, 170 bp, Homo sapiens
aacacagagaggtggatcaaaatcattattgccagatttcttgcagactccgaaggaagttgtatgcactacccaaaacacaccaactgtaaagaaatcccgggatactgctctcaagaaattagaatttagttcttcaccagattctttaagtaccatcaatgattggg

SEQ ID NO: 4051 - DNA, 170 bp, Homo sapiens
cattattgccagatttcttgcagactccgaaggaagttgtatgcactacccaaaacacaccaactgtaaagaaatcccgggatactgctctcaagaaattagaatttagttcttcaccagattctttaagtaccatcaatgattgggatgatatggatgactttgatact

SEQ ID NO: 4052 - DNA, 170 bp, Homo sapiens
ccgaaggaagttgtatgcactacccaaaacacaccaactgtaaagaaatcccgggatactgctctcaagaaattagaatttagttcttcaccagattctttaagtaccatcaatgattgggatgatatggatgactttgatacttctgagacttcaaaatcatttgttac

SEQ ID NO: 4053 - DNA, 170 bp, Homo sapiens
acccaaaacacaccaactgtaaagaaatcccgggatactgctctcaagaaattagaatttagttcttcaccagattctttaagtaccatcaatgattgggatgatatggatgactttgatacttctgagacttcaaaatcatttgttacaccaccccaaagtcactttgt

SEQ ID NO: 4054 - DNA, 170 bp, Homo sapiens
cccgggatactgctctcaagaaattagaatttagttcttcaccagattctttaagtaccatcaatgattgggatgatatggatgactttgatacttctgagacttcaaaatcatttgttacaccaccccaaagtcactttgtaagagtaagcactgctcagaaatcaaaa

SEQ ID NO: 4055 - DNA, 170 bp, Homo sapiens
tttagttcttcaccagattctttaagtaccatcaatgattgggatgatatggatgactttgatacttctgagacttcaaaatcatttgttacaccaccccaaagtcactttgtaagagtaagcactgctcagaaatcaaaaaagggtaagagaaacttttttaaagcaca

SEQ ID NO: 4056 - DNA, 170 bp, Homo sapiens
ttaagtaccatcaatgattgggatgatatggatgactttgatacttctgagacttcaaaatcatttgttacaccaccccaaagtcactttgtaagagtaagcactgctcagaaatcaaaaaagggtaagagaaacttttttaaagcacagctttatacaacaaacacagt

SEQ ID NO: 4057 - DNA, 170 bp, Homo sapiens
ttaaaaaattagttttgtagagttggggggtttcttaaaatggatccatctaatctagtttttccattatttttcagaggtttcacttttaaaaagaaaacatcttcagataacaatgtatctgtaactaatgtgtcagtagcaaaaacacctgtattaagaaataaaga

SEQ ID NO: 4058 - DNA, 170 bp, Homo sapiens
tgatatggatgactttgatacttctgagacttcaaaatcatttgttacaccaccccaaagtcactttgtaagagtaagcactgctcagaaatcaaaaaagggtaagagaaacttttttaaagcacagctttatacaacaaacacagtaaagactgatttgcctccaccct

SEQ ID NO: 4059 - DNA, 170 bp, Homo sapiens
tctgagacttcaaaatcatttgttacaccaccccaaagtcactttgtaagagtaagcactgctcagaaatcaaaaaagggtaagagaaacttttttaaagcacagctttatacaacaaacacagtaaagactgatttgcctccaccctcctctgaaagcgagcaaataga

SEQ ID NO: 4060 - DNA, 170 bp, Homo sapiens
accccaaagtcactttgtaagagtaagcactgctcagaaatcaaaaaagggtaagagaaacttttttaaagcacagctttatacaacaaacacagtaaagactgatttgcctccaccctcctctgaaagcgagcaaatagatttgactgaggaacagaaggatgactcag

SEQ ID NO: 4061 - DNA, 170 bp, Homo sapiens
gcactgctcagaaatcaaaaaagggtaagagaaacttttttaaagcacagctttatacaacaaacacagtaaagactgatttgcctccaccctcctctgaaagcgagcaaatagatttgactgaggaacagaaggatgactcagaatggttaagcagcgatgtgatttgc

SEQ ID NO: 4062 - DNA, 170 bp, Homo sapiens
agggtaagagaaacttttttaaagcacagctttatacaacaaacacagtaaagactgatttgcctccaccctcctctgaaagcgagcaaatagatttgactgaggaacagaaggatgactcagaatggttaagcagcgatgtgatttgcatcgatgatggccccattgct

SEQ ID NO: 4063 - DNA, 170 bp, Homo sapiens
cagctttatacaacaaacacagtaaagactgatttgcctccaccctcctctgaaagcgagcaaatagatttgactgaggaacagaaggatgactcagaatggttaagcagcgatgtgatttgcatcgatgatggccccattgctgaagtgcatataaatgaagatgctca

SEQ ID NO: 4064 - DNA, 170 bp, Homo sapiens
tgatttgcctccaccctcctctgaaagcgagcaaatagatttgactgaggaacagaaggatgactcagaatggttaagcagcgatgtgatttgcatcgatgatggccccattgctgaagtgcatataaatgaagatgctcaggaaagtgactctctgaaaactcatttgg

SEQ ID NO: 4065 - DNA, 170 bp, Homo sapiens
gagcaaatagatttgactgaggaacagaaggatgactcagaatggttaagcagcgatgtgatttgcatcgatgatggccccattgctgaagtgcatataaatgaagatgctcaggaaagtgactctctgaaaactcatttggaagatgaaagaggtaacaattattttat

SEQ ID NO: 4066 - DNA, 170 bp, Homo sapiens
acagaaggatgactcagaatggttaagcagcgatgtgatttgcatcgatgatggccccattgctgaagtgcatataaatgaagatgctcaggaaagtgactctctgaaaactcatttggaagatgaaagaggtaacaattattttatcttcattttagtatgttcattgt

SEQ ID NO: 4067 - DNA, 170 bp, Homo sapiens
taagcagcgatgtgatttgcatcgatgatggccccattgctgaagtgcatataaatgaagatgctcaggaaagtgactctctgaaaactcatttggaagatgaaagaggtaacaattattttatcttcattttagtatgttcattgtacttttttattcaaagctagcca

SEQ ID NO: 4068 - DNA, 170 bp, Homo sapiens
agttggggggtttcttaaaatggatccatctaatctagtttttccattatttttcagaggtttcacttttaaaaagaaaacatcttcagataacaatgtatctgtaactaatgtgtcagtagcaaaaacacctgtattaagaaataaagatgttaatgttaccgaagact

SEQ ID NO: 4069 - DNA, 170 bp, Homo sapiens
tggccccattgctgaagtgcatataaatgaagatgctcaggaaagtgactctctgaaaactcatttggaagatgaaagaggtaacaattattttatcttcattttagtatgttcattgtacttttttattcaaagctagccattgggaatagtcatgaatatatagagct

SEQ ID NO: 4070 - DNA, 170 bp, Homo sapiens
taaatgaagatgctcaggaaagtgactctctgaaaactcatttggaagatgaaagaggtaacaattattttatcttcattttagtatgttcattgtacttttttattcaaagctagccattgggaatagtcatgaatatatagagcttttgtccttaaggttgttagggt

SEQ ID NO: 4071 - DNA, 170 bp, Homo sapiens
agtgactctctgaaaactcatttggaagatgaaagaggtaacaattattttatcttcattttagtatgttcattgtacttttttattcaaagctagccattgggaatagtcatgaatatatagagcttttgtccttaaggttgttagggtctttagtggtgctttttgaa

SEQ ID NO: 4072 - DNA, 170 bp, Homo sapiens
tccatctaatctagtttttccattatttttcagaggtttcacttttaaaaagaaaacatcttcagataacaatgtatctgtaactaatgtgtcagtagcaaaaacacctgtattaagaaataaagatgttaatgttaccgaagacttttccttcagtgaacctctaccca

SEQ ID NO: 4073 - DNA, 170 bp, Homo sapiens
tttttcagaggtttcacttttaaaaagaaaacatcttcagataacaatgtatctgtaactaatgtgtcagtagcaaaaacacctgtattaagaaataaagatgttaatgttaccgaagacttttccttcagtgaacctctacccaacaccacaaatcagcaaagggtcaa

SEQ ID NO: 4074 - DNA, 170 bp, Homo sapiens
agaaaacatcttcagataacaatgtatctgtaactaatgtgtcagtagcaaaaacacctgtattaagaaataaagatgttaatgttaccgaagacttttccttcagtgaacctctacccaacaccacaaatcagcaaagggtcaaggacttctttaaaaatgctccagca

SEQ ID NO: 4075 - DNA, 170 bp, Homo sapiens
tctgtaactaatgtgtcagtagcaaaaacacctgtattaagaaataaagatgttaatgttaccgaagacttttccttcagtgaacctctacccaacaccacaaatcagcaaagggtcaaggacttctttaaaaatgctccagcaggacaggaaacacagagaggtggatc

SEQ ID NO: 4076 - DNA, 170 bp, Homo sapiens
aacacctgtattaagaaataaagatgttaatgttaccgaagacttttccttcagtgaacctctacccaacaccacaaatcagcaaagggtcaaggacttctttaaaaatgctccagcaggacaggaaacacagagaggtggatcaaaatcattattgccagatttcttgc

SEQ ID NO: 4077 - DNA, 170 bp, Homo sapiens
tgttaatgttaccgaagacttttccttcagtgaacctctacccaacaccacaaatcagcaaagggtcaaggacttctttaaaaatgctccagcaggacaggaaacacagagaggtggatcaaaatcattattgccagatttcttgcagactccgaaggaagttgtatgca

SEQ ID NO: 4078 - DNA, 170 bp, Homo sapiens
tgctgaattgttgaatccatatggcagggaagcagctaggtatctgctaaaatgggcccctgcagcgtgtctcttcatatacactaaaaacacgtggaccagtgcgacatcacctgtaaacatctgcattttccatttgtagctgaagacagttccccagggataagcct

SEQ ID NO: 4079 - DNA, 170 bp, Homo sapiens
agggaagcagctaggtatctgctaaaatgggcccctgcagcgtgtctcttcatatacactaaaaacacgtggaccagtgcgacatcacctgtaaacatctgcattttccatttgtagctgaagacagttccccagggataagcctgtccagcagcagaggccccggaaga

SEQ ID NO: 4080 - DNA, 170 bp, Homo sapiens
agtaaaaccagaaatgaaaggaagaggaaaaagatgccagcctcccaaaggtctaagaggagaaaaactgcttccagtggttccaaggcaaaggggtatgttttgtgacatctttttcaatatagggaacaagggaagaaaggacaaaagtgcaacagctctgccttgct

SEQ ID NO: 4081 - DNA, 170 bp, Homo sapiens
tgccagcctcccaaaggtctaagaggagaaaaactgcttccagtggttccaaggcaaaggggtatgttttgtgacatctttttcaatatagggaacaagggaagaaaggacaaaagtgcaacagctctgccttgctttgaaggatttattaaaataagccattattaaat

SEQ ID NO: 4082 - DNA, 170 bp, Homo sapiens
agaggagaaaaactgcttccagtggttccaaggcaaaggggtatgttttgtgacatctttttcaatatagggaacaagggaagaaaggacaaaagtgcaacagctctgccttgctttgaaggatttattaaaataagccattattaaatattgctaatggaatgacagtt

SEQ ID NO: 4083 - DNA, 170 bp, Homo sapiens
gcccctgcagcgtgtctcttcatatacactaaaaacacgtggaccagtgcgacatcacctgtaaacatctgcattttccatttgtagctgaagacagttccccagggataagcctgtccagcagcagaggccccggaagaagtgccgctgaggagctcgacgaggaaata

SEQ ID NO: 4084 - DNA, 170 bp, Homo sapiens
acactaaaaacacgtggaccagtgcgacatcacctgtaaacatctgcattttccatttgtagctgaagacagttccccagggataagcctgtccagcagcagaggccccggaagaagtgccgctgaggagctcgacgaggaaatacccgtatcttcccactactttgcaa

SEQ ID NO: 4085 - DNA, 170 bp, Homo sapiens
gacatcacctgtaaacatctgcattttccatttgtagctgaagacagttccccagggataagcctgtccagcagcagaggccccggaagaagtgccgctgaggagctcgacgaggaaatacccgtatcttcccactactttgcaagtaaaaccagaaatgaaaggaagag

SEQ ID NO: 4086 - DNA, 170 bp, Homo sapiens
gcattttccatttgtagctgaagacagttccccagggataagcctgtccagcagcagaggccccggaagaagtgccgctgaggagctcgacgaggaaatacccgtatcttcccactactttgcaagtaaaaccagaaatgaaaggaagaggaaaaagatgccagcctccc

SEQ ID NO: 4087 - DNA, 170 bp, Homo sapiens
ccccagggataagcctgtccagcagcagaggccccggaagaagtgccgctgaggagctcgacgaggaaatacccgtatcttcccactactttgcaagtaaaaccagaaatgaaaggaagaggaaaaagatgccagcctcccaaaggtctaagaggagaaaaactgcttcc

SEQ ID NO: 4088 - DNA, 170 bp, Homo sapiens
agaggccccggaagaagtgccgctgaggagctcgacgaggaaatacccgtatcttcccactactttgcaagtaaaaccagaaatgaaaggaagaggaaaaagatgccagcctcccaaaggtctaagaggagaaaaactgcttccagtggttccaaggcaaaggggtatgt

SEQ ID NO: 4089 - DNA, 170 bp, Homo sapiens
ggagctcgacgaggaaatacccgtatcttcccactactttgcaagtaaaaccagaaatgaaaggaagaggaaaaagatgccagcctcccaaaggtctaagaggagaaaaactgcttccagtggttccaaggcaaaggggtatgttttgtgacatctttttcaatataggg

SEQ ID NO: 4090 - DNA, 170 bp, Homo sapiens
tcttcccactactttgcaagtaaaaccagaaatgaaaggaagaggaaaaagatgccagcctcccaaaggtctaagaggagaaaaactgcttccagtggttccaaggcaaaggggtatgttttgtgacatctttttcaatatagggaacaagggaagaaaggacaaaagtg

SEQ ID NO: 4091 - DNA, 170 bp, Homo sapiens
ggggctcgtaggcagaaaatgcacaaggacacattaggcccagggaagtggtattgtagctctgtgcaggttgagaggaaggtcattcatttttggtttcatttaacattttgatttttttctttgtcacatttcagggggtctgccacatgtagaaagatatcttccaa

SEQ ID NO: 4092 - DNA, 170 bp, Homo sapiens
aggacacattaggcccagggaagtggtattgtagctctgtgcaggttgagaggaaggtcattcatttttggtttcatttaacattttgatttttttctttgtcacatttcagggggtctgccacatgtagaaagatatcttccaaaacgaaatcctccagcatcattgga

SEQ ID NO: 4093 - DNA, 170 bp, Homo sapiens
gattatggctccaccgaagcctataaatagaccgtttcttaagccttcatatgcattctcataacaaccgaatctcaatgtacatagaccctctttcttgtttgtcagcatctgaccatctgtgactataaagctgttattcttgttataccatttgaagtttttactcg

SEQ ID NO: 4094 - DNA, 170 bp, Homo sapiens
agaccgtttcttaagccttcatatgcattctcataacaaccgaatctcaatgtacatagaccctctttcttgtttgtcagcatctgaccatctgtgactataaagctgttattcttgttataccatttgaagtttttactcgtctctattaatatttaaataaatgctgg

SEQ ID NO: 4095 - DNA, 170 bp, Homo sapiens
tggtattgtagctctgtgcaggttgagaggaaggtcattcatttttggtttcatttaacattttgatttttttctttgtcacatttcagggggtctgccacatgtagaaagatatcttccaaaacgaaatcctccagcatcattggatccagttcagcctcacatacttc

SEQ ID NO: 4096 - DNA, 170 bp, Homo sapiens
agaggaaggtcattcatttttggtttcatttaacattttgatttttttctttgtcacatttcagggggtctgccacatgtagaaagatatcttccaaaacgaaatcctccagcatcattggatccagttcagcctcacatacttctcaagcgacatcaggagccaatagc

SEQ ID NO: 4097 - DNA, 170 bp, Homo sapiens
ttcatttaacattttgatttttttctttgtcacatttcagggggtctgccacatgtagaaagatatcttccaaaacgaaatcctccagcatcattggatccagttcagcctcacatacttctcaagcgacatcaggagccaatagcaaattggggattatggctccaccg

SEQ ID NO: 4098 - DNA, 170 bp, Homo sapiens
tcacatttcagggggtctgccacatgtagaaagatatcttccaaaacgaaatcctccagcatcattggatccagttcagcctcacatacttctcaagcgacatcaggagccaatagcaaattggggattatggctccaccgaagcctataaatagaccgtttcttaagcc

SEQ ID NO: 4099 - DNA, 170 bp, Homo sapiens
tgtagaaagatatcttccaaaacgaaatcctccagcatcattggatccagttcagcctcacatacttctcaagcgacatcaggagccaatagcaaattggggattatggctccaccgaagcctataaatagaccgtttcttaagccttcatatgcattctcataacaacc

SEQ ID NO: 4100 - DNA, 170 bp, Homo sapiens
aatcctccagcatcattggatccagttcagcctcacatacttctcaagcgacatcaggagccaatagcaaattggggattatggctccaccgaagcctataaatagaccgtttcttaagccttcatatgcattctcataacaaccgaatctcaatgtacatagaccctct

SEQ ID NO: 4101 - DNA, 170 bp, Homo sapiens
agttcagcctcacatacttctcaagcgacatcaggagccaatagcaaattggggattatggctccaccgaagcctataaatagaccgtttcttaagccttcatatgcattctcataacaaccgaatctcaatgtacatagaccctctttcttgtttgtcagcatctgacc

SEQ ID NO: 4102 - DNA, 170 bp, Homo sapiens
acatcaggagccaatagcaaattggggattatggctccaccgaagcctataaatagaccgtttcttaagccttcatatgcattctcataacaaccgaatctcaatgtacatagaccctctttcttgtttgtcagcatctgaccatctgtgactataaagctgttattctt

SEQ ID NO: 4103 - DNA, 170 bp, Homo sapiens
ttagcatgtaaagggagaggatccatacaaagtggtgtgattgtttgtgacttgccagaagcactcattcttaatcgctcatgccctgttctttctgtctcattagtggttaacaaatctatgtttatcaactgttttactgtagataatagcgaaaagaagaagaattt

SEQ ID NO: 4104 - DNA, 170 bp, Homo sapiens
acaaagtggtgtgattgtttgtgacttgccagaagcactcattcttaatcgctcatgccctgttctttctgtctcattagtggttaacaaatctatgtttatcaactgttttactgtagataatagcgaaaagaagaagaatttggaagaagctgaattacattcaactg

SEQ ID NO: 4105 - DNA, 170 bp, Homo sapiens
gttccaccttctccagaagaaattatttctgcttcttcttcctcttcaaaatgccttaggtaaactagctaaataattagcattattatttgtttctgggatactttaaattgtttaatttagtttataatatcatttctatataaaagtattttgtgctttctacaatt

SEQ ID NO: 4106 - DNA, 170 bp, Homo sapiens
tttctgcttcttcttcctcttcaaaatgccttaggtaaactagctaaataattagcattattatttgtttctgggatactttaaattgtttaatttagtttataatatcatttctatataaaagtattttgtgctttctacaattattttacattcaagtgaaagcctca

SEQ ID NO: 4107 - DNA, 170 bp, Homo sapiens
gtgacttgccagaagcactcattcttaatcgctcatgccctgttctttctgtctcattagtggttaacaaatctatgtttatcaactgttttactgtagataatagcgaaaagaagaagaatttggaagaagctgaattacattcaactgagaaagttccatgtattgaa

SEQ ID NO: 4108 - DNA, 170 bp, Homo sapiens
tcttaatcgctcatgccctgttctttctgtctcattagtggttaacaaatctatgtttatcaactgttttactgtagataatagcgaaaagaagaagaatttggaagaagctgaattacattcaactgagaaagttccatgtattgaatttgatgatgatgattatgata

SEQ ID NO: 4109 - DNA, 170 bp, Homo sapiens
tctgtctcattagtggttaacaaatctatgtttatcaactgttttactgtagataatagcgaaaagaagaagaatttggaagaagctgaattacattcaactgagaaagttccatgtattgaatttgatgatgatgattatgatacggattttgttccaccttctccaga

SEQ ID NO: 4110 - DNA, 170 bp, Homo sapiens
tgtttatcaactgttttactgtagataatagcgaaaagaagaagaatttggaagaagctgaattacattcaactgagaaagttccatgtattgaatttgatgatgatgattatgatacggattttgttccaccttctccagaagaaattatttctgcttcttcttcctct

SEQ ID NO: 4111 - DNA, 170 bp, Homo sapiens
taatagcgaaaagaagaagaatttggaagaagctgaattacattcaactgagaaagttccatgtattgaatttgatgatgatgattatgatacggattttgttccaccttctccagaagaaattatttctgcttcttcttcctcttcaaaatgccttaggtaaactagct

SEQ ID NO: 4112 - DNA, 170 bp, Homo sapiens
agaagctgaattacattcaactgagaaagttccatgtattgaatttgatgatgatgattatgatacggattttgttccaccttctccagaagaaattatttctgcttcttcttcctcttcaaaatgccttaggtaaactagctaaataattagcattattatttgtttct

SEQ ID NO: 4113 - DNA, 170 bp, Homo sapiens
agaaagttccatgtattgaatttgatgatgatgattatgatacggattttgttccaccttctccagaagaaattatttctgcttcttcttcctcttcaaaatgccttaggtaaactagctaaataattagcattattatttgtttctgggatactttaaattgtttaatt

SEQ ID NO: 4114 - DNA, 170 bp, Homo sapiens
tgatgattatgatacggattttgttccaccttctccagaagaaattatttctgcttcttcttcctcttcaaaatgccttaggtaaactagctaaataattagcattattatttgtttctgggatactttaaattgtttaatttagtttataatatcatttctatataaaa

SEQ ID NO: 4115 - DNA, 170 bp, Homo sapiens
ggaaatttaaaaaactacttctcttttctgttatatattgtctgatcagtggtagaaaaatattaagggtttcaaaattatacatttattgagtctagcctatagtatgattggcttaacattttttttatttgcagtacgttaaaggaccttgacacctctgacagaaa

SEQ ID NO: 4116 - DNA, 170 bp, Homo sapiens
ctgttatatattgtctgatcagtggtagaaaaatattaagggtttcaaaattatacatttattgagtctagcctatagtatgattggcttaacattttttttatttgcagtacgttaaaggaccttgacacctctgacagaaaagaggatgttcttagcacatcaaaaga

SEQ ID NO: 4117 - DNA, 170 bp, Homo sapiens
atattaagggtttcaaaattatacatttattgagtctagcctatagtatgattggcttaacattttttttatttgcagtacgttaaaggaccttgacacctctgacagaaaagaggatgttcttagcacatcaaaagatcttttgtcaaaacctgagaaaatgagtatgc

SEQ ID NO: 4118 - DNA, 170 bp, Homo sapiens
tacatttattgagtctagcctatagtatgattggcttaacattttttttatttgcagtacgttaaaggaccttgacacctctgacagaaaagaggatgttcttagcacatcaaaagatcttttgtcaaaacctgagaaaatgagtatgcaggagctgaatccagaaacca

SEQ ID NO: 4119 - DNA, 170 bp, Homo sapiens
agtatgattggcttaacattttttttatttgcagtacgttaaaggaccttgacacctctgacagaaaagaggatgttcttagcacatcaaaagatcttttgtcaaaacctgagaaaatgagtatgcaggagctgaatccagaaaccagcacagactgtgacggtacaagc

SEQ ID NO: 4120 - DNA, 170 bp, Homo sapiens
tgcagtacgttaaaggaccttgacacctctgacagaaaagaggatgttcttagcacatcaaaagatcttttgtcaaaacctgagaaaatgagtatgcaggagctgaatccagaaaccagcacagactgtgacggtacaagcaatattttagacataccatgtatttcaac

SEQ ID NO: 4121 - DNA, 170 bp, Homo sapiens
tctgacagaaaagaggatgttcttagcacatcaaaagatcttttgtcaaaacctgagaaaatgagtatgcaggagctgaatccagaaaccagcacagactgtgacggtacaagcaatattttagacataccatgtatttcaactacttacttttgaaaacaacgtaacac

SEQ ID NO: 4122 - DNA, 170 bp, Homo sapiens
tcttagcacatcaaaagatcttttgtcaaaacctgagaaaatgagtatgcaggagctgaatccagaaaccagcacagactgtgacggtacaagcaatattttagacataccatgtatttcaactacttacttttgaaaacaacgtaacacaaagattgtgttttgaacct

SEQ ID NO: 4123 - DNA, 170 bp, Homo sapiens
tcaaaacctgagaaaatgagtatgcaggagctgaatccagaaaccagcacagactgtgacggtacaagcaatattttagacataccatgtatttcaactacttacttttgaaaacaacgtaacacaaagattgtgttttgaacctgtggctgtatgttataaaatggcag

SEQ ID NO: 4124 - DNA, 170 bp, Homo sapiens
ggagctgaatccagaaaccagcacagactgtgacggtacaagcaatattttagacataccatgtatttcaactacttacttttgaaaacaacgtaacacaaagattgtgttttgaacctgtggctgtatgttataaaatggcagatttgtagtttcttttcttctaatgt

SEQ ID NO: 4125 - DNA, 170 bp, Homo sapiens
ggtcttgaactcctggacttaagcaatcctcctgccttggcctccccaaagggctgggattacagtcatgagccaccatgcctagccaagacttttttttttttccctcaaagaaaaatattaacaacataattattttatagctagacagataagtttacagcagcagc

SEQ ID NO: 4126 - DNA, 170 bp, Homo sapiens
tcctgccttggcctccccaaagggctgggattacagtcatgagccaccatgcctagccaagacttttttttttttccctcaaagaaaaatattaacaacataattattttatagctagacagataagtttacagcagcagcttattcatgtgatggagcacatctgtaaa

SEQ ID NO: 4127 - DNA, 170 bp, Homo sapiens
gcttcagcagcggaacataaggtatcttaattttcccccttctggaatatatctgattatatttctaccactctaagtgaaaaatggacagggcaaaatgttcaggctttctggcctggaaatggcataaggatgatcatcatgccactatgtttttgatttgtttactt

SEQ ID NO: 4128 - DNA, 170 bp, Homo sapiens
gctgggattacagtcatgagccaccatgcctagccaagacttttttttttttccctcaaagaaaaatattaacaacataattattttatagctagacagataagtttacagcagcagcttattcatgtgatggagcacatctgtaaattaattgatactattcctgatga

SEQ ID NO: 4129 - DNA, 170 bp, Homo sapiens
tgcctagccaagacttttttttttttccctcaaagaaaaatattaacaacataattattttatagctagacagataagtttacagcagcagcttattcatgtgatggagcacatctgtaaattaattgatactattcctgatgataaactgaaacttttggattgtggga

SEQ ID NO: 4130 - DNA, 170 bp, Homo sapiens
tttttccctcaaagaaaaatattaacaacataattattttatagctagacagataagtttacagcagcagcttattcatgtgatggagcacatctgtaaattaattgatactattcctgatgataaactgaaacttttggattgtgggaacgaactgcttcagcagcgga

SEQ ID NO: 4131 - DNA, 170 bp, Homo sapiens
acataattattttatagctagacagataagtttacagcagcagcttattcatgtgatggagcacatctgtaaattaattgatactattcctgatgataaactgaaacttttggattgtgggaacgaactgcttcagcagcggaacataaggtatcttaattttccccctt

SEQ ID NO: 4132 - DNA, 170 bp, Homo sapiens
ttacagcagcagcttattcatgtgatggagcacatctgtaaattaattgatactattcctgatgataaactgaaacttttggattgtgggaacgaactgcttcagcagcggaacataaggtatcttaattttcccccttctggaatatatctgattatatttctaccact

SEQ ID NO: 4133 - DNA, 170 bp, Homo sapiens
tgatggagcacatctgtaaattaattgatactattcctgatgataaactgaaacttttggattgtgggaacgaactgcttcagcagcggaacataaggtatcttaattttcccccttctggaatatatctgattatatttctaccactctaagtgaaaaatggacagggc

SEQ ID NO: 4134 - DNA, 170 bp, Homo sapiens
aattgatactattcctgatgataaactgaaacttttggattgtgggaacgaactgcttcagcagcggaacataaggtatcttaattttcccccttctggaatatatctgattatatttctaccactctaagtgaaaaatggacagggcaaaatgttcaggctttctggcc

SEQ ID NO: 4135 - DNA, 170 bp, Homo sapiens
tgaaacttttggattgtgggaacgaactgcttcagcagcggaacataaggtatcttaattttcccccttctggaatatatctgattatatttctaccactctaagtgaaaaatggacagggcaaaatgttcaggctttctggcctggaaatggcataaggatgatcatca

SEQ ID NO: 4136 - DNA, 170 bp, Homo sapiens
cattcgtattcatgtttttaagattgggaaaaaagcgaatatattttgctacaatttctatttggtatgaaaactacagatttgcttttgtggcctaccagagtaaactacttatatttaatacgttgttctcttttctctcttcagaaggaaacttctaacggaagtag

SEQ ID NO: 4137 - DNA, 170 bp, Homo sapiens
gggaaaaaagcgaatatattttgctacaatttctatttggtatgaaaactacagatttgcttttgtggcctaccagagtaaactacttatatttaatacgttgttctcttttctctcttcagaaggaaacttctaacggaagtagattttaataaaagtgatgccagtct

SEQ ID NO: 4138 - DNA, 170 bp, Homo sapiens
cctgccctacagggaattctatgaaggagttaaatttttcacaccttccctcaaattctgtttctcctggggactgtttactgactaccaccctaggaaagacaggattctctgccaccaggaagaatctttttgaaaggcctttattcaatacccatttacagaagtcc

SEQ ID NO: 4139 - DNA, 170 bp, Homo sapiens
tgaaggagttaaatttttcacaccttccctcaaattctgtttctcctggggactgtttactgactaccaccctaggaaagacaggattctctgccaccaggaagaatctttttgaaaggcctttattcaatacccatttacagaagtcctttgtaagtagcaactgggct

SEQ ID NO: 4140 - DNA, 170 bp, Homo sapiens
ccctcaaattctgtttctcctggggactgtttactgactaccaccctaggaaagacaggattctctgccaccaggaagaatctttttgaaaggcctttattcaatacccatttacagaagtcctttgtaagtagcaactgggctgaaacaccaagactaggaaaaaaaaa

SEQ ID NO: 4141 - DNA, 170 bp, Homo sapiens
tgtttactgactaccaccctaggaaagacaggattctctgccaccaggaagaatctttttgaaaggcctttattcaatacccatttacagaagtcctttgtaagtagcaactgggctgaaacaccaagactaggaaaaaaaaatgaaagctcttatttcccaggaaatgt

SEQ ID NO: 4142 - DNA, 170 bp, Homo sapiens
aagacaggattctctgccaccaggaagaatctttttgaaaggcctttattcaatacccatttacagaagtcctttgtaagtagcaactgggctgaaacaccaagactaggaaaaaaaaatgaaagctcttatttcccaggaaatgttctcacaagcactgctgtgaaaga

SEQ ID NO: 4143 - DNA, 170 bp, Homo sapiens
agaatctttttgaaaggcctttattcaatacccatttacagaagtcctttgtaagtagcaactgggctgaaacaccaagactaggaaaaaaaaatgaaagctcttatttcccaggaaatgttctcacaagcactgctgtgaaagatcagaataaacatactgcttcaata

SEQ ID NO: 4144 - DNA, 170 bp, Homo sapiens
aatacccatttacagaagtcctttgtaagtagcaactgggctgaaacaccaagactaggaaaaaaaaatgaaagctcttatttcccaggaaatgttctcacaagcactgctgtgaaagatcagaataaacatactgcttcaataaatgacttagaaagagaaacccaacc

SEQ ID NO: 4145 - DNA, 170 bp, Homo sapiens
agcaactgggctgaaacaccaagactaggaaaaaaaaatgaaagctcttatttcccaggaaatgttctcacaagcactgctgtgaaagatcagaataaacatactgcttcaataaatgacttagaaagagaaacccaaccttcctatgatattgataattttgacataga

SEQ ID NO: 4146 - DNA, 170 bp, Homo sapiens
ccaagactaggaaaaaaaaatgaaagctcttatttcccaggaaatgttctcacaagcactgctgtgaaagatcagaataaacatactgcttcaataaatgacttagaaagagaaacccaaccttcctatgatattgataattttgacatagatgactttgatgatgatga

SEQ ID NO: 4147 - DNA, 170 bp, Homo sapiens
agctcttatttcccaggaaatgttctcacaagcactgctgtgaaagatcagaataaacatactgcttcaataaatgacttagaaagagaaacccaaccttcctatgatattgataattttgacatagatgactttgatgatgatgatgactgggaagacataatgcataa

SEQ ID NO: 4148 - DNA, 170 bp, Homo sapiens
caatttctatttggtatgaaaactacagatttgcttttgtggcctaccagagtaaactacttatatttaatacgttgttctcttttctctcttcagaaggaaacttctaacggaagtagattttaataaaagtgatgccagtcttcttggctcattgtggagatacaggc

SEQ ID NO: 4149 - DNA, 170 bp, Homo sapiens
acaagcactgctgtgaaagatcagaataaacatactgcttcaataaatgacttagaaagagaaacccaaccttcctatgatattgataattttgacatagatgactttgatgatgatgatgactgggaagacataatgcataatttagcagccagcaaatcttccacagc

SEQ ID NO: 4150 - DNA, 170 bp, Homo sapiens
taaacatactgcttcaataaatgacttagaaagagaaacccaaccttcctatgatattgataattttgacatagatgactttgatgatgatgatgactgggaagacataatgcataatttagcagccagcaaatcttccacagctgcctatcaacccatcaaggaaggtc

SEQ ID NO: 4151 - DNA, 170 bp, Homo sapiens
agaaagagaaacccaaccttcctatgatattgataattttgacatagatgactttgatgatgatgatgactgggaagacataatgcataatttagcagccagcaaatcttccacagctgcctatcaacccatcaaggaaggtcggccaattaaatcagtatcagaaagac

SEQ ID NO: 4152 - DNA, 170 bp, Homo sapiens
tcctatgatattgataattttgacatagatgactttgatgatgatgatgactgggaagacataatgcataatttagcagccagcaaatcttccacagctgcctatcaacccatcaaggaaggtcggccaattaaatcagtatcagaaagactttcctcagccaagacaga

SEQ ID NO: 4153 - DNA, 170 bp, Homo sapiens
gatgactttgatgatgatgatgactgggaagacataatgcataatttagcagccagcaaatcttccacagctgcctatcaacccatcaaggaaggtcggccaattaaatcagtatcagaaagactttcctcagccaagacagactgtcttccagtgtcatctactgctca

SEQ ID NO: 4154 - DNA, 170 bp, Homo sapiens
ctgggaagacataatgcataatttagcagccagcaaatcttccacagctgcctatcaacccatcaaggaaggtcggccaattaaatcagtatcagaaagactttcctcagccaagacagactgtcttccagtgtcatctactgctcaaaatataaacttctcagagtcaa

SEQ ID NO: 4155 - DNA, 170 bp, Homo sapiens
ccagcaaatcttccacagctgcctatcaacccatcaaggaaggtcggccaattaaatcagtatcagaaagactttcctcagccaagacagactgtcttccagtgtcatctactgctcaaaatataaacttctcagagtcaattcagaattatactggtaagtttaaaata

SEQ ID NO: 4156 - DNA, 170 bp, Homo sapiens
acccatcaaggaaggtcggccaattaaatcagtatcagaaagactttcctcagccaagacagactgtcttccagtgtcatctactgctcaaaatataaacttctcagagtcaattcagaattatactggtaagtttaaaataaattgaatgcttatatgaaaacaaaact

SEQ ID NO: 4157 - DNA, 170 bp, Homo sapiens
gccaattaaatcagtatcagaaagactttcctcagccaagacagactgtcttccagtgtcatctactgctcaaaatataaacttctcagagtcaattcagaattatactggtaagtttaaaataaattgaatgcttatatgaaaacaaaactgtcccaaaataggaatta

SEQ ID NO: 4158 - DNA, 170 bp, Homo sapiens
ttcctcagccaagacagactgtcttccagtgtcatctactgctcaaaatataaacttctcagagtcaattcagaattatactggtaagtttaaaataaattgaatgcttatatgaaaacaaaactgtcccaaaataggaattatataagaaaaaccatagcaaatcatca

SEQ ID NO: 4159 - DNA, 170 bp, Homo sapiens
cagatttgcttttgtggcctaccagagtaaactacttatatttaatacgttgttctcttttctctcttcagaaggaaacttctaacggaagtagattttaataaaagtgatgccagtcttcttggctcattgtggagatacaggcctgattcacttgatggccctatgga

SEQ ID NO: 4160 - DNA, 170 bp, Homo sapiens
cagtgtcatctactgctcaaaatataaacttctcagagtcaattcagaattatactggtaagtttaaaataaattgaatgcttatatgaaaacaaaactgtcccaaaataggaattatataagaaaaaccatagcaaatcatcattgcctgaaaacattgttgctatgca

SEQ ID NO: 4161 - DNA, 170 bp, Homo sapiens
acttctcagagtcaattcagaattatactggtaagtttaaaataaattgaatgcttatatgaaaacaaaactgtcccaaaataggaattatataagaaaaaccatagcaaatcatcattgcctgaaaacattgttgctatgcaaatttctactgatgatatgaattacaa

SEQ ID NO: 4162 - DNA, 170 bp, Homo sapiens
cagagtaaactacttatatttaatacgttgttctcttttctctcttcagaaggaaacttctaacggaagtagattttaataaaagtgatgccagtcttcttggctcattgtggagatacaggcctgattcacttgatggccctatggagggtgattcctgccctacaggg

SEQ ID NO: 4163 - DNA, 170 bp, Homo sapiens
tctcttttctctcttcagaaggaaacttctaacggaagtagattttaataaaagtgatgccagtcttcttggctcattgtggagatacaggcctgattcacttgatggccctatggagggtgattcctgccctacagggaattctatgaaggagttaaatttttcacacc

SEQ ID NO: 4164 - DNA, 170 bp, Homo sapiens
acttctaacggaagtagattttaataaaagtgatgccagtcttcttggctcattgtggagatacaggcctgattcacttgatggccctatggagggtgattcctgccctacagggaattctatgaaggagttaaatttttcacaccttccctcaaattctgtttctcctg

SEQ ID NO: 4165 - DNA, 170 bp, Homo sapiens
aaaagtgatgccagtcttcttggctcattgtggagatacaggcctgattcacttgatggccctatggagggtgattcctgccctacagggaattctatgaaggagttaaatttttcacaccttccctcaaattctgtttctcctggggactgtttactgactaccaccct

SEQ ID NO: 4166 - DNA, 170 bp, Homo sapiens
cattgtggagatacaggcctgattcacttgatggccctatggagggtgattcctgccctacagggaattctatgaaggagttaaatttttcacaccttccctcaaattctgtttctcctggggactgtttactgactaccaccctaggaaagacaggattctctgccacc

SEQ ID NO: 4167 - DNA, 170 bp, Homo sapiens
gattcacttgatggccctatggagggtgattcctgccctacagggaattctatgaaggagttaaatttttcacaccttccctcaaattctgtttctcctggggactgtttactgactaccaccctaggaaagacaggattctctgccaccaggaagaatctttttgaaag

SEQ ID NO: 4168 - DNA, 170 bp, Homo sapiens
gtaaagagtttaagaactgtgctgcagggaaacgtgtgccagtgattctgcagggcaagggaaatgctaaagctgtactttcactgtattcatgtactgatttttcttaacgttgattattttcctagacaagtcagcacaaaatttagcatccagaaatctgaaacatg

SEQ ID NO: 4169 - DNA, 170 bp, Homo sapiens
gggaaacgtgtgccagtgattctgcagggcaagggaaatgctaaagctgtactttcactgtattcatgtactgatttttcttaacgttgattattttcctagacaagtcagcacaaaatttagcatccagaaatctgaaacatgagcgtttccaaagtcttagttttcct

SEQ ID NO: 4170 - DNA, 170 bp, Homo sapiens
ttagaactaatcagctagaggcgatcaatgctgcactgcttggtgaagactgttttatcctgatgccgactggtatgtatttttagaagtgaattggcaggaatccattggcagatgttaaatgaaagctctttaatagaaataaaaagaccacctacacagtatttcta

SEQ ID NO: 4171 - DNA, 170 bp, Homo sapiens
tgctgcactgcttggtgaagactgttttatcctgatgccgactggtatgtatttttagaagtgaattggcaggaatccattggcagatgttaaatgaaagctctttaatagaaataaaaagaccacctacacagtatttctatcatttagggacctcttaaacctcctgt

SEQ ID NO: 4172 - DNA, 170 bp, Homo sapiens
tgcagggcaagggaaatgctaaagctgtactttcactgtattcatgtactgatttttcttaacgttgattattttcctagacaagtcagcacaaaatttagcatccagaaatctgaaacatgagcgtttccaaagtcttagttttcctcatacaaaggaaatgatgaaga

SEQ ID NO: 4173 - DNA, 170 bp, Homo sapiens
tgtactttcactgtattcatgtactgatttttcttaacgttgattattttcctagacaagtcagcacaaaatttagcatccagaaatctgaaacatgagcgtttccaaagtcttagttttcctcatacaaaggaaatgatgaagatttttcataaaaaatttggcctgca

SEQ ID NO: 4174 - DNA, 170 bp, Homo sapiens
tttttcttaacgttgattattttcctagacaagtcagcacaaaatttagcatccagaaatctgaaacatgagcgtttccaaagtcttagttttcctcatacaaaggaaatgatgaagatttttcataaaaaatttggcctgcataattttagaactaatcagctagaggc

SEQ ID NO: 4175 - DNA, 170 bp, Homo sapiens
tcctagacaagtcagcacaaaatttagcatccagaaatctgaaacatgagcgtttccaaagtcttagttttcctcatacaaaggaaatgatgaagatttttcataaaaaatttggcctgcataattttagaactaatcagctagaggcgatcaatgctgcactgcttggt

SEQ ID NO: 4176 - DNA, 170 bp, Homo sapiens
agcatccagaaatctgaaacatgagcgtttccaaagtcttagttttcctcatacaaaggaaatgatgaagatttttcataaaaaatttggcctgcataattttagaactaatcagctagaggcgatcaatgctgcactgcttggtgaagactgttttatcctgatgccga

SEQ ID NO: 4177 - DNA, 170 bp, Homo sapiens
ttccaaagtcttagttttcctcatacaaaggaaatgatgaagatttttcataaaaaatttggcctgcataattttagaactaatcagctagaggcgatcaatgctgcactgcttggtgaagactgttttatcctgatgccgactggtatgtatttttagaagtgaattgg

SEQ ID NO: 4178 - DNA, 170 bp, Homo sapiens
catacaaaggaaatgatgaagatttttcataaaaaatttggcctgcataattttagaactaatcagctagaggcgatcaatgctgcactgcttggtgaagactgttttatcctgatgccgactggtatgtatttttagaagtgaattggcaggaatccattggcagatgt

SEQ ID NO: 4179 - DNA, 170 bp, Homo sapiens
aaaaatttggcctgcataattttagaactaatcagctagaggcgatcaatgctgcactgcttggtgaagactgttttatcctgatgccgactggtatgtatttttagaagtgaattggcaggaatccattggcagatgttaaatgaaagctctttaatagaaataaaaag

SEQ ID NO: 4180 - DNA, 170 bp, Homo sapiens
tgagtcatttgagtatggcaaattgttggcaccagggacaatatgccttggtgtcctattaatgatatgatttcttttgtaacttttacattcatgctctgaagacagaacctgacagatattttttcattgttctctttcaggaggtggtaagagtttgtgttaccagc

SEQ ID NO: 4181 - DNA, 170 bp, Homo sapiens
tggcaccagggacaatatgccttggtgtcctattaatgatatgatttcttttgtaacttttacattcatgctctgaagacagaacctgacagatattttttcattgttctctttcaggaggtggtaagagtttgtgttaccagctccctgcctgtgtttctcctggggtc

SEQ ID NO: 4182 - DNA, 170 bp, Homo sapiens
tggtgtcctattaatgatatgatttcttttgtaacttttacattcatgctctgaagacagaacctgacagatattttttcattgttctctttcaggaggtggtaagagtttgtgttaccagctccctgcctgtgtttctcctggggtcactgttgtcatttctcccttga

SEQ ID NO: 4183 - DNA, 170 bp, Homo sapiens
tttgtaacttttacattcatgctctgaagacagaacctgacagatattttttcattgttctctttcaggaggtggtaagagtttgtgttaccagctccctgcctgtgtttctcctggggtcactgttgtcatttctcccttgagatcacttatcgtagatcaagtccaaa

SEQ ID NO: 4184 - DNA, 170 bp, Homo sapiens
tgaagacagaacctgacagatattttttcattgttctctttcaggaggtggtaagagtttgtgttaccagctccctgcctgtgtttctcctggggtcactgttgtcatttctcccttgagatcacttatcgtagatcaagtccaaaagctgacttccttggatgtaagtt

SEQ ID NO: 4185 - DNA, 170 bp, Homo sapiens
ttctctttcaggaggtggtaagagtttgtgttaccagctccctgcctgtgtttctcctggggtcactgttgtcatttctcccttgagatcacttatcgtagatcaagtccaaaagctgacttccttggatgtaagttataaaaatactaataaaaacacgccttagaaac

SEQ ID NO: 4186 - DNA, 170 bp, Homo sapiens
agagtttgtgttaccagctccctgcctgtgtttctcctggggtcactgttgtcatttctcccttgagatcacttatcgtagatcaagtccaaaagctgacttccttggatgtaagttataaaaatactaataaaaacacgccttagaaacaattaaatttcagtcctctg

SEQ ID NO: 4187 - DNA, 170 bp, Homo sapiens
gcctgtgtttctcctggggtcactgttgtcatttctcccttgagatcacttatcgtagatcaagtccaaaagctgacttccttggatgtaagttataaaaatactaataaaaacacgccttagaaacaattaaatttcagtcctctggataacctttttattaaatagtt

SEQ ID NO: 4188 - DNA, 170 bp, Homo sapiens
gtcatttctcccttgagatcacttatcgtagatcaagtccaaaagctgacttccttggatgtaagttataaaaatactaataaaaacacgccttagaaacaattaaatttcagtcctctggataacctttttattaaatagttcgtgatttgtaaaaaataaagcacagc

SEQ ID NO: 4189 - DNA, 170 bp, Homo sapiens
gtagatcaagtccaaaagctgacttccttggatgtaagttataaaaatactaataaaaacacgccttagaaacaattaaatttcagtcctctggataacctttttattaaatagttcgtgatttgtaaaaaataaagcacagcagttaaatttgcagttgaacagaagtc

SEQ ID NO: 4190 - DNA, 170 bp, Homo sapiens
acttgttatgttgagatatgtatttcctttgataggtttgatatgtgactaataaaatatttataaaacctaaggacaaatgtaattttgtcaggttaatgtataaaattgaaattgtttactacttttatacttagattccagctacatatctgacaggtgataagact

SEQ ID NO: 4191 - DNA, 170 bp, Homo sapiens
cctttgataggtttgatatgtgactaataaaatatttataaaacctaaggacaaatgtaattttgtcaggttaatgtataaaattgaaattgtttactacttttatacttagattccagctacatatctgacaggtgataagactgactcagaagctacaaatatttacc

SEQ ID NO: 4192 - DNA, 170 bp, Homo sapiens
actaataaaatatttataaaacctaaggacaaatgtaattttgtcaggttaatgtataaaattgaaattgtttactacttttatacttagattccagctacatatctgacaggtgataagactgactcagaagctacaaatatttacctccagttatcaaaaaaagaccc

SEQ ID NO: 4193 - DNA, 170 bp, Homo sapiens
acaaatgtaattttgtcaggttaatgtataaaattgaaattgtttactacttttatacttagattccagctacatatctgacaggtgataagactgactcagaagctacaaatatttacctccagttatcaaaaaaagacccaatcataaaacttctatatgtcactcca

SEQ ID NO: 4194 - DNA, 170 bp, Homo sapiens
tgtataaaattgaaattgtttactacttttatacttagattccagctacatatctgacaggtgataagactgactcagaagctacaaatatttacctccagttatcaaaaaaagacccaatcataaaacttctatatgtcactccagaaaaggtttgtatttatatcatt

SEQ ID NO: 4195 - DNA, 170 bp, Homo sapiens
ttatacttagattccagctacatatctgacaggtgataagactgactcagaagctacaaatatttacctccagttatcaaaaaaagacccaatcataaaacttctatatgtcactccagaaaaggtttgtatttatatcattattttaaaatatattaaagaccactaga

SEQ ID NO: 4196 - DNA, 170 bp, Homo sapiens
tgacaggtgataagactgactcagaagctacaaatatttacctccagttatcaaaaaaagacccaatcataaaacttctatatgtcactccagaaaaggtttgtatttatatcattattttaaaatatattaaagaccactagaatacatatatttttaagattttaaca

SEQ ID NO: 4197 - DNA, 170 bp, Homo sapiens
cagaagctacaaatatttacctccagttatcaaaaaaagacccaatcataaaacttctatatgtcactccagaaaaggtttgtatttatatcattattttaaaatatattaaagaccactagaatacatatatttttaagattttaacaaaattttgtatacgtagtgca

SEQ ID NO: 4198 - DNA, 170 bp, Homo sapiens
ttatcaaaaaaagacccaatcataaaacttctatatgtcactccagaaaaggtttgtatttatatcattattttaaaatatattaaagaccactagaatacatatatttttaagattttaacaaaattttgtatacgtagtgcaaagaatttttgtacaactttcatcca

SEQ ID NO: 4199 - DNA, 170 bp, Homo sapiens
acttctatatgtcactccagaaaaggtttgtatttatatcattattttaaaatatattaaagaccactagaatacatatatttttaagattttaacaaaattttgtatacgtagtgcaaagaatttttgtacaactttcatccagaaaccccaaatggtaacattttact

SEQ ID NO: 4200 - DNA, 170 bp, Homo sapiens
ggggtgggtggggggaattggaagcaaatgacatcacagcaggtcagagaaaaagggttgagcggcaggcacccagagtagtaggtctttggcattaggagcttgagcccagacggccctagcagggaccccagcgcccgagagaccatgcagaggtcgcctctggaaaa

SEQ ID NO: 4201 - DNA, 170 bp, Homo sapiens
acatcacagcaggtcagagaaaaagggttgagcggcaggcacccagagtagtaggtctttggcattaggagcttgagcccagacggccctagcagggaccccagcgcccgagagaccatgcagaggtcgcctctggaaaaggccagcgttgtctccaaactttttttcag

SEQ ID NO: 4202 - DNA, 170 bp, Homo sapiens
aaaaagggttgagcggcaggcacccagagtagtaggtctttggcattaggagcttgagcccagacggccctagcagggaccccagcgcccgagagaccatgcagaggtcgcctctggaaaaggccagcgttgtctccaaactttttttcaggtgagaaggtggccaaccg

SEQ ID NO: 4203 - DNA, 170 bp, Homo sapiens
ccagagtagtaggtctttggcattaggagcttgagcccagacggccctagcagggaccccagcgcccgagagaccatgcagaggtcgcctctggaaaaggccagcgttgtctccaaactttttttcaggtgagaaggtggccaaccgagcttcggaaagacacgtgccca

SEQ ID NO: 4204 - DNA, 170 bp, Homo sapiens
cttgagcccagacggccctagcagggaccccagcgcccgagagaccatgcagaggtcgcctctggaaaaggccagcgttgtctccaaactttttttcaggtgagaaggtggccaaccgagcttcggaaagacacgtgcccacgaaagaggagggcgtgtgtatgggttgg

SEQ ID NO: 4205 - DNA, 170 bp, Homo sapiens
ccccagcgcccgagagaccatgcagaggtcgcctctggaaaaggccagcgttgtctccaaactttttttcaggtgagaaggtggccaaccgagcttcggaaagacacgtgcccacgaaagaggagggcgtgtgtatgggttgggtttggggtaaaggaataagcagtttt

SEQ ID NO: 4206 - DNA, 170 bp, Homo sapiens
cagaggtcgcctctggaaaaggccagcgttgtctccaaactttttttcaggtgagaaggtggccaaccgagcttcggaaagacacgtgcccacgaaagaggagggcgtgtgtatgggttgggtttggggtaaaggaataagcagtttttaaaaagatgcgctatcattca

SEQ ID NO: 4207 - DNA, 170 bp, Homo sapiens
ttgtctccaaactttttttcaggtgagaaggtggccaaccgagcttcggaaagacacgtgcccacgaaagaggagggcgtgtgtatgggttgggtttggggtaaaggaataagcagtttttaaaaagatgcgctatcattcattgttttgaaagaaaatgtgggtattgt

SEQ ID NO: 4208 - DNA, 170 bp, Homo sapiens
tacagtgtaatggatcatgggccatgtgcttttcaaactaattgtacataaaacaagcatctattgaaaatatctgacaaactcatcttttatttttgatgtgtgtgtgtgtgtgtgtgtgtttttttaacagggatttggggaattatttgagaaagcaaaacaaaaca

SEQ ID NO: 4209 - DNA, 170 bp, Homo sapiens
tgcttttcaaactaattgtacataaaacaagcatctattgaaaatatctgacaaactcatcttttatttttgatgtgtgtgtgtgtgtgtgtgtgtttttttaacagggatttggggaattatttgagaaagcaaaacaaaacaataacaatagaaaaacttctaatggt

SEQ ID NO: 4210 - DNA, 170 bp, Homo sapiens
agatattaatttcaagatagaaagaggacagttgttggcggttgctggatccactggagcaggcaaggtagttcttttgttcttcactattaagaacttaatttggtgtccatgtctctttttttttctagtttgtagtgctggaaggtatttttggagaaattcttaca

SEQ ID NO: 4211 - DNA, 170 bp, Homo sapiens
acagttgttggcggttgctggatccactggagcaggcaaggtagttcttttgttcttcactattaagaacttaatttggtgtccatgtctctttttttttctagtttgtagtgctggaaggtatttttggagaaattcttacatgagcattaggagaatgtatgggtgta

SEQ ID NO: 4212 - DNA, 170 bp, Homo sapiens
taaaacaagcatctattgaaaatatctgacaaactcatcttttatttttgatgtgtgtgtgtgtgtgtgtgtgtttttttaacagggatttggggaattatttgagaaagcaaaacaaaacaataacaatagaaaaacttctaatggtgatgacagcctcttcttcagta

SEQ ID NO: 4213 - DNA, 170 bp, Homo sapiens
ctgacaaactcatcttttatttttgatgtgtgtgtgtgtgtgtgtgtgtttttttaacagggatttggggaattatttgagaaagcaaaacaaaacaataacaatagaaaaacttctaatggtgatgacagcctcttcttcagtaatttctcacttcttggtactcctgt

SEQ ID NO: 4214 - DNA, 170 bp, Homo sapiens
tgtgtgtgtgtgtgtgtgtttttttaacagggatttggggaattatttgagaaagcaaaacaaaacaataacaatagaaaaacttctaatggtgatgacagcctcttcttcagtaatttctcacttcttggtactcctgtcctgaaagatattaatttcaagatagaaag

SEQ ID NO: 4215 - DNA, 170 bp, Homo sapiens
ttttaacagggatttggggaattatttgagaaagcaaaacaaaacaataacaatagaaaaacttctaatggtgatgacagcctcttcttcagtaatttctcacttcttggtactcctgtcctgaaagatattaatttcaagatagaaagaggacagttgttggcggttgc

SEQ ID NO: 4216 - DNA, 170 bp, Homo sapiens
tttgagaaagcaaaacaaaacaataacaatagaaaaacttctaatggtgatgacagcctcttcttcagtaatttctcacttcttggtactcctgtcctgaaagatattaatttcaagatagaaagaggacagttgttggcggttgctggatccactggagcaggcaaggt

SEQ ID NO: 4217 - DNA, 170 bp, Homo sapiens
agaaaaacttctaatggtgatgacagcctcttcttcagtaatttctcacttcttggtactcctgtcctgaaagatattaatttcaagatagaaagaggacagttgttggcggttgctggatccactggagcaggcaaggtagttcttttgttcttcactattaagaactt

SEQ ID NO: 4218 - DNA, 170 bp, Homo sapiens
tgacagcctcttcttcagtaatttctcacttcttggtactcctgtcctgaaagatattaatttcaagatagaaagaggacagttgttggcggttgctggatccactggagcaggcaaggtagttcttttgttcttcactattaagaacttaatttggtgtccatgtctct

SEQ ID NO: 4219 - DNA, 170 bp, Homo sapiens
cacttcttggtactcctgtcctgaaagatattaatttcaagatagaaagaggacagttgttggcggttgctggatccactggagcaggcaaggtagttcttttgttcttcactattaagaacttaatttggtgtccatgtctctttttttttctagtttgtagtgctgga

SEQ ID NO: 4220 - DNA, 170 bp, Homo sapiens
acaggaagtattttaaatattttgaatcaaatgagttaatagaatctttacaaataagaatatacacttctgcttaggatgataattggaggcaagtgaatcctgagcgtgatttgataatgacctaataatgatgggttttatttccagacttcacttctaatggtgat

SEQ ID NO: 4221 - DNA, 170 bp, Homo sapiens
tcaaatgagttaatagaatctttacaaataagaatatacacttctgcttaggatgataattggaggcaagtgaatcctgagcgtgatttgataatgacctaataatgatgggttttatttccagacttcacttctaatggtgattatgggagaactggagccttcagagg

SEQ ID NO: 4222 - DNA, 170 bp, Homo sapiens
cctggcaccattaaagaaaatatcatctttggtgtttcctatgatgaatatagatacagaagcgtcatcaaagcatgccaactagaagaggtaagaaactatgtgaaaactttttgattatgcatatgaacccttcacactacccaaattatatatttggctccatattc

SEQ ID NO: 4223 - DNA, 170 bp, Homo sapiens
tggtgtttcctatgatgaatatagatacagaagcgtcatcaaagcatgccaactagaagaggtaagaaactatgtgaaaactttttgattatgcatatgaacccttcacactacccaaattatatatttggctccatattcaatcggttagtctacatatatttatgttt

SEQ ID NO: 4224 - DNA, 170 bp, Homo sapiens
agatacagaagcgtcatcaaagcatgccaactagaagaggtaagaaactatgtgaaaactttttgattatgcatatgaacccttcacactacccaaattatatatttggctccatattcaatcggttagtctacatatatttatgtttcctctatgggtaagctactgtg

SEQ ID NO: 4225 - DNA, 170 bp, Homo sapiens
acaaataagaatatacacttctgcttaggatgataattggaggcaagtgaatcctgagcgtgatttgataatgacctaataatgatgggttttatttccagacttcacttctaatggtgattatgggagaactggagccttcagagggtaaaattaagcacagtggaaga

SEQ ID NO: 4226 - DNA, 170 bp, Homo sapiens
ggatgataattggaggcaagtgaatcctgagcgtgatttgataatgacctaataatgatgggttttatttccagacttcacttctaatggtgattatgggagaactggagccttcagagggtaaaattaagcacagtggaagaatttcattctgttctcagttttcctgg

SEQ ID NO: 4227 - DNA, 170 bp, Homo sapiens
tcctgagcgtgatttgataatgacctaataatgatgggttttatttccagacttcacttctaatggtgattatgggagaactggagccttcagagggtaaaattaagcacagtggaagaatttcattctgttctcagttttcctggattatgcctggcaccattaaagaa

SEQ ID NO: 4228 - DNA, 170 bp, Homo sapiens
acctaataatgatgggttttatttccagacttcacttctaatggtgattatgggagaactggagccttcagagggtaaaattaagcacagtggaagaatttcattctgttctcagttttcctggattatgcctggcaccattaaagaaaatatcatctttggtgtttcct

SEQ ID NO: 4229 - DNA, 170 bp, Homo sapiens
ttctaatggtgattatgggagaactggagccttcagagggtaaaattaagcacagtggaagaatttcattctgttctcagttttcctggattatgcctggcaccattaaagaaaatatcatctttggtgtttcctatgatgaatatagatacagaagcgtcatcaaagca

SEQ ID NO: 4230 - DNA, 170 bp, Homo sapiens
aactggagccttcagagggtaaaattaagcacagtggaagaatttcattctgttctcagttttcctggattatgcctggcaccattaaagaaaatatcatctttggtgtttcctatgatgaatatagatacagaagcgtcatcaaagcatgccaactagaagaggtaaga

SEQ ID NO: 4231 - DNA, 170 bp, Homo sapiens
agcacagtggaagaatttcattctgttctcagttttcctggattatgcctggcaccattaaagaaaatatcatctttggtgtttcctatgatgaatatagatacagaagcgtcatcaaagcatgccaactagaagaggtaagaaactatgtgaaaactttttgattatgc

SEQ ID NO: 4232 - DNA, 170 bp, Homo sapiens
ctgttctcagttttcctggattatgcctggcaccattaaagaaaatatcatctttggtgtttcctatgatgaatatagatacagaagcgtcatcaaagcatgccaactagaagaggtaagaaactatgtgaaaactttttgattatgcatatgaacccttcacactaccc

SEQ ID NO: 4233 - DNA, 170 bp, Homo sapiens
aatggagatgcaatgttcaaaatttcaactgtggttaaagcaatagtgtgatatatgattacattagaaggaagatgtgcctttcaaattcagattgagcatactaaaagtgactctctaattttctatttttggtaataggacatctccaagtttgcagagaaagacaa

SEQ ID NO: 4234 - DNA, 170 bp, Homo sapiens
ttcaactgtggttaaagcaatagtgtgatatatgattacattagaaggaagatgtgcctttcaaattcagattgagcatactaaaagtgactctctaattttctatttttggtaataggacatctccaagtttgcagagaaagacaatatagttcttggagaaggtggaa

SEQ ID NO: 4235 - DNA, 170 bp, Homo sapiens
tgtgatatatgattacattagaaggaagatgtgcctttcaaattcagattgagcatactaaaagtgactctctaattttctatttttggtaataggacatctccaagtttgcagagaaagacaatatagttcttggagaaggtggaatcacactgagtggaggtcaacga

SEQ ID NO: 4236 - DNA, 170 bp, Homo sapiens
tgtgcctttcaaattcagattgagcatactaaaagtgactctctaattttctatttttggtaataggacatctccaagtttgcagagaaagacaatatagttcttggagaaggtggaatcacactgagtggaggtcaacgagcaagaatttctttagcaaggtgaataac

SEQ ID NO: 4237 - DNA, 170 bp, Homo sapiens
gagcatactaaaagtgactctctaattttctatttttggtaataggacatctccaagtttgcagagaaagacaatatagttcttggagaaggtggaatcacactgagtggaggtcaacgagcaagaatttctttagcaaggtgaataactaattattggtctagcaagca

SEQ ID NO: 4238 - DNA, 170 bp, Homo sapiens
ctatttttggtaataggacatctccaagtttgcagagaaagacaatatagttcttggagaaggtggaatcacactgagtggaggtcaacgagcaagaatttctttagcaaggtgaataactaattattggtctagcaagcatttgctgtaaatgtcattcatgtaaaaaa

SEQ ID NO: 4239 - DNA, 170 bp, Homo sapiens
agtttgcagagaaagacaatatagttcttggagaaggtggaatcacactgagtggaggtcaacgagcaagaatttctttagcaaggtgaataactaattattggtctagcaagcatttgctgtaaatgtcattcatgtaaaaaaattacagacatttctctattgcttta

SEQ ID NO: 4240 - DNA, 170 bp, Homo sapiens
tcttggagaaggtggaatcacactgagtggaggtcaacgagcaagaatttctttagcaaggtgaataactaattattggtctagcaagcatttgctgtaaatgtcattcatgtaaaaaaattacagacatttctctattgctttatattctgtttctggaattgaaaaaa

SEQ ID NO: 4241 - DNA, 170 bp, Homo sapiens
agtggaggtcaacgagcaagaatttctttagcaaggtgaataactaattattggtctagcaagcatttgctgtaaatgtcattcatgtaaaaaaattacagacatttctctattgctttatattctgtttctggaattgaaaaaatcctggggttttatggctagtgggt

SEQ ID NO: 4242 - DNA, 170 bp, Homo sapiens
tgcaccacttttgagaatagtgttatttcagtgaatcgatgtggtgaccatattgtaatgcatgtagtgaactgtttaaggcaaatcatctacactagatgaccaggaaatagagaggaaatgtaatttaatttccattttctttttagagcagtatacaaagatgctga

SEQ ID NO: 4243 - DNA, 170 bp, Homo sapiens
ttcagtgaatcgatgtggtgaccatattgtaatgcatgtagtgaactgtttaaggcaaatcatctacactagatgaccaggaaatagagaggaaatgtaatttaatttccattttctttttagagcagtatacaaagatgctgatttgtatttattagactctccttttg

SEQ ID NO: 4244 - DNA, 170 bp, Homo sapiens
tgtaatgcatgtagtgaactgtttaaggcaaatcatctacactagatgaccaggaaatagagaggaaatgtaatttaatttccattttctttttagagcagtatacaaagatgctgatttgtatttattagactctccttttggatacctagatgttttaacagaaaaag

SEQ ID NO: 4245 - DNA, 170 bp, Homo sapiens
aggcaaatcatctacactagatgaccaggaaatagagaggaaatgtaatttaatttccattttctttttagagcagtatacaaagatgctgatttgtatttattagactctccttttggatacctagatgttttaacagaaaaagaaatatttgaaaggtatgttctttg

SEQ ID NO: 4246 - DNA, 170 bp, Homo sapiens
gaccaggaaatagagaggaaatgtaatttaatttccattttctttttagagcagtatacaaagatgctgatttgtatttattagactctccttttggatacctagatgttttaacagaaaaagaaatatttgaaaggtatgttctttgaataccttacttataatgctca

SEQ ID NO: 4247 - DNA, 170 bp, Homo sapiens
tttaatttccattttctttttagagcagtatacaaagatgctgatttgtatttattagactctccttttggatacctagatgttttaacagaaaaagaaatatttgaaaggtatgttctttgaataccttacttataatgctcatgctaaaataaaagaaagacagactg

SEQ ID NO: 4248 - DNA, 170 bp, Homo sapiens
tatacaaagatgctgatttgtatttattagactctccttttggatacctagatgttttaacagaaaaagaaatatttgaaaggtatgttctttgaataccttacttataatgctcatgctaaaataaaagaaagacagactgtcccatcatagattgcattttacctctt

SEQ ID NO: 4249 - DNA, 170 bp, Homo sapiens
tattagactctccttttggatacctagatgttttaacagaaaaagaaatatttgaaaggtatgttctttgaataccttacttataatgctcatgctaaaataaaagaaagacagactgtcccatcatagattgcattttacctcttgagaaatatgttcaccattgttgg

SEQ ID NO: 4250 - DNA, 170 bp, Homo sapiens
ctagatgttttaacagaaaaagaaatatttgaaaggtatgttctttgaataccttacttataatgctcatgctaaaataaaagaaagacagactgtcccatcatagattgcattttacctcttgagaaatatgttcaccattgttggtatggcagaatgtagcatggtat

SEQ ID NO: 4251 - DNA, 170 bp, Homo sapiens
agaatcatttaaaatataataaaattgtatgatagagattatatgcaataaaacattaacaaaatgctaaaatacgagacatattgcaataaagtatttataaaattgatatttatatgtttttatatcttaaagctgtgtctgtaaactgatggctaacaaaactagga

SEQ ID NO: 4252 - DNA, 170 bp, Homo sapiens
aattgtatgatagagattatatgcaataaaacattaacaaaatgctaaaatacgagacatattgcaataaagtatttataaaattgatatttatatgtttttatatcttaaagctgtgtctgtaaactgatggctaacaaaactaggattttggtcacttctaaaatgga

SEQ ID NO: 4253 - DNA, 170 bp, Homo sapiens
tgggacattttcagaactccaaaatctacagccagactttagctcaaaactcatgggatgtgattctttcgaccaatttagtgcagaaagaagaaattcaatcctaactgagaccttacaccgtttctcattagaaggagatgctcctgtctcctggacagaaacaaaaa

SEQ ID NO: 4254 - DNA, 170 bp, Homo sapiens
tacagccagactttagctcaaaactcatgggatgtgattctttcgaccaatttagtgcagaaagaagaaattcaatcctaactgagaccttacaccgtttctcattagaaggagatgctcctgtctcctggacagaaacaaaaaaacaatcttttaaacagactggagag

SEQ ID NO: 4255 - DNA, 170 bp, Homo sapiens
tcatgggatgtgattctttcgaccaatttagtgcagaaagaagaaattcaatcctaactgagaccttacaccgtttctcattagaaggagatgctcctgtctcctggacagaaacaaaaaaacaatcttttaaacagactggagagtttggggaaaaaaggaagaattct

SEQ ID NO: 4256 - DNA, 170 bp, Homo sapiens
gtgcagaaagaagaaattcaatcctaactgagaccttacaccgtttctcattagaaggagatgctcctgtctcctggacagaaacaaaaaaacaatcttttaaacagactggagagtttggggaaaaaaggaagaattctattctcaatccaatcaactctatacgaaaa

SEQ ID NO: 4257 - DNA, 170 bp, Homo sapiens
tcctaactgagaccttacaccgtttctcattagaaggagatgctcctgtctcctggacagaaacaaaaaaacaatcttttaaacagactggagagtttggggaaaaaaggaagaattctattctcaatccaatcaactctatacgaaaattttccattgtgcaaaagact

SEQ ID NO: 4258 - DNA, 170 bp, Homo sapiens
ttctcattagaaggagatgctcctgtctcctggacagaaacaaaaaaacaatcttttaaacagactggagagtttggggaaaaaaggaagaattctattctcaatccaatcaactctatacgaaaattttccattgtgcaaaagactcccttacaaatgaatggcatcga

SEQ ID NO: 4259 - DNA, 170 bp, Homo sapiens
ctcctggacagaaacaaaaaaacaatcttttaaacagactggagagtttggggaaaaaaggaagaattctattctcaatccaatcaactctatacgaaaattttccattgtgcaaaagactcccttacaaatgaatggcatcgaagaggattctgatgagcctttagaga

SEQ ID NO: 4260 - DNA, 170 bp, Homo sapiens
caatcttttaaacagactggagagtttggggaaaaaaggaagaattctattctcaatccaatcaactctatacgaaaattttccattgtgcaaaagactcccttacaaatgaatggcatcgaagaggattctgatgagcctttagagagaaggctgtccttagtaccaga

SEQ ID NO: 4261 - DNA, 170 bp, Homo sapiens
tggggaaaaaaggaagaattctattctcaatccaatcaactctatacgaaaattttccattgtgcaaaagactcccttacaaatgaatggcatcgaagaggattctgatgagcctttagagagaaggctgtccttagtaccagattctgagcagggagaggcgatactgc

SEQ ID NO: 4262 - DNA, 170 bp, Homo sapiens
aatccaatcaactctatacgaaaattttccattgtgcaaaagactcccttacaaatgaatggcatcgaagaggattctgatgagcctttagagagaaggctgtccttagtaccagattctgagcagggagaggcgatactgcctcgcatcagcgtgatcagcactggccc

SEQ ID NO: 4263 - DNA, 170 bp, Homo sapiens
gcaataaaacattaacaaaatgctaaaatacgagacatattgcaataaagtatttataaaattgatatttatatgtttttatatcttaaagctgtgtctgtaaactgatggctaacaaaactaggattttggtcacttctaaaatggaacatttaaagaaagctgacaaa

SEQ ID NO: 4264 - DNA, 170 bp, Homo sapiens
aattttccattgtgcaaaagactcccttacaaatgaatggcatcgaagaggattctgatgagcctttagagagaaggctgtccttagtaccagattctgagcagggagaggcgatactgcctcgcatcagcgtgatcagcactggccccacgcttcaggcacgaaggagg

SEQ ID NO: 4265 - DNA, 170 bp, Homo sapiens
ccttacaaatgaatggcatcgaagaggattctgatgagcctttagagagaaggctgtccttagtaccagattctgagcagggagaggcgatactgcctcgcatcagcgtgatcagcactggccccacgcttcaggcacgaaggaggcagtctgtcctgaacctgatgaca

SEQ ID NO: 4266 - DNA, 170 bp, Homo sapiens
ggattctgatgagcctttagagagaaggctgtccttagtaccagattctgagcagggagaggcgatactgcctcgcatcagcgtgatcagcactggccccacgcttcaggcacgaaggaggcagtctgtcctgaacctgatgacacactcagttaaccaaggtcagaaca

SEQ ID NO: 4267 - DNA, 170 bp, Homo sapiens
ggctgtccttagtaccagattctgagcagggagaggcgatactgcctcgcatcagcgtgatcagcactggccccacgcttcaggcacgaaggaggcagtctgtcctgaacctgatgacacactcagttaaccaaggtcagaacattcaccgaaagacaacagcatccaca

SEQ ID NO: 4268 - DNA, 170 bp, Homo sapiens
gcagggagaggcgatactgcctcgcatcagcgtgatcagcactggccccacgcttcaggcacgaaggaggcagtctgtcctgaacctgatgacacactcagttaaccaaggtcagaacattcaccgaaagacaacagcatccacacgaaaagtgtcactggcccctcagg

SEQ ID NO: 4269 - DNA, 170 bp, Homo sapiens
cgcatcagcgtgatcagcactggccccacgcttcaggcacgaaggaggcagtctgtcctgaacctgatgacacactcagttaaccaaggtcagaacattcaccgaaagacaacagcatccacacgaaaagtgtcactggcccctcaggcaaacttgactgaactggatat

SEQ ID NO: 4270 - DNA, 170 bp, Homo sapiens
tcaggcacgaaggaggcagtctgtcctgaacctgatgacacactcagttaaccaaggtcagaacattcaccgaaagacaacagcatccacacgaaaagtgtcactggcccctcaggcaaacttgactgaactggatatatattcaagaaggttatctcaagaaactggct

SEQ ID NO: 4271 - DNA, 170 bp, Homo sapiens
cctgaacctgatgacacactcagttaaccaaggtcagaacattcaccgaaagacaacagcatccacacgaaaagtgtcactggcccctcaggcaaacttgactgaactggatatatattcaagaaggttatctcaagaaactggcttggaaataagtgaagaaattaacg

SEQ ID NO: 4272 - DNA, 170 bp, Homo sapiens
aaccaaggtcagaacattcaccgaaagacaacagcatccacacgaaaagtgtcactggcccctcaggcaaacttgactgaactggatatatattcaagaaggttatctcaagaaactggcttggaaataagtgaagaaattaacgaagaagacttaaaggtaggtataca

SEQ ID NO: 4273 - DNA, 170 bp, Homo sapiens
aagacaacagcatccacacgaaaagtgtcactggcccctcaggcaaacttgactgaactggatatatattcaagaaggttatctcaagaaactggcttggaaataagtgaagaaattaacgaagaagacttaaaggtaggtatacatcgcttgggggtatttcaccccac

SEQ ID NO: 4274 - DNA, 170 bp, Homo sapiens
tacgagacatattgcaataaagtatttataaaattgatatttatatgtttttatatcttaaagctgtgtctgtaaactgatggctaacaaaactaggattttggtcacttctaaaatggaacatttaaagaaagctgacaaaatattaattttgcatgaaggtagcagct

SEQ ID NO: 4275 - DNA, 170 bp, Homo sapiens
actggcccctcaggcaaacttgactgaactggatatatattcaagaaggttatctcaagaaactggcttggaaataagtgaagaaattaacgaagaagacttaaaggtaggtatacatcgcttgggggtatttcaccccacagaatgcaattgagtagaatgcaatatgt

SEQ ID NO: 4276 - DNA, 170 bp, Homo sapiens
tgactgaactggatatatattcaagaaggttatctcaagaaactggcttggaaataagtgaagaaattaacgaagaagacttaaaggtaggtatacatcgcttgggggtatttcaccccacagaatgcaattgagtagaatgcaatatgtagcatgtaacaaaatttact

SEQ ID NO: 4277 - DNA, 170 bp, Homo sapiens
aggttatctcaagaaactggcttggaaataagtgaagaaattaacgaagaagacttaaaggtaggtatacatcgcttgggggtatttcaccccacagaatgcaattgagtagaatgcaatatgtagcatgtaacaaaatttactaaaatcataggattaggataaggtgt

SEQ ID NO: 4278 - DNA, 170 bp, Homo sapiens
ggaaataagtgaagaaattaacgaagaagacttaaaggtaggtatacatcgcttgggggtatttcaccccacagaatgcaattgagtagaatgcaatatgtagcatgtaacaaaatttactaaaatcataggattaggataaggtgtatcttaaaactcagaaagtatga

SEQ ID NO: 4279 - DNA, 170 bp, Homo sapiens
tttataaaattgatatttatatgtttttatatcttaaagctgtgtctgtaaactgatggctaacaaaactaggattttggtcacttctaaaatggaacatttaaagaaagctgacaaaatattaattttgcatgaaggtagcagctatttttatgggacattttcagaac

SEQ ID NO: 4280 - DNA, 170 bp, Homo sapiens
tatcttaaagctgtgtctgtaaactgatggctaacaaaactaggattttggtcacttctaaaatggaacatttaaagaaagctgacaaaatattaattttgcatgaaggtagcagctatttttatgggacattttcagaactccaaaatctacagccagactttagctca

SEQ ID NO: 4281 - DNA, 170 bp, Homo sapiens
gatggctaacaaaactaggattttggtcacttctaaaatggaacatttaaagaaagctgacaaaatattaattttgcatgaaggtagcagctatttttatgggacattttcagaactccaaaatctacagccagactttagctcaaaactcatgggatgtgattctttcg

SEQ ID NO: 4282 - DNA, 170 bp, Homo sapiens
tggtcacttctaaaatggaacatttaaagaaagctgacaaaatattaattttgcatgaaggtagcagctatttttatgggacattttcagaactccaaaatctacagccagactttagctcaaaactcatgggatgtgattctttcgaccaatttagtgcagaaagaaga

SEQ ID NO: 4283 - DNA, 170 bp, Homo sapiens
aagaaagctgacaaaatattaattttgcatgaaggtagcagctatttttatgggacattttcagaactccaaaatctacagccagactttagctcaaaactcatgggatgtgattctttcgaccaatttagtgcagaaagaagaaattcaatcctaactgagaccttaca

SEQ ID NO: 4284 - DNA, 170 bp, Homo sapiens
tgcatgaaggtagcagctatttttatgggacattttcagaactccaaaatctacagccagactttagctcaaaactcatgggatgtgattctttcgaccaatttagtgcagaaagaagaaattcaatcctaactgagaccttacaccgtttctcattagaaggagatgct

SEQ ID NO: 4285 - DNA, 170 bp, Homo sapiens
tttatatttgttaaaatacacttagattcaagtaatactattcttttattttcatatattaaaaataaaaccacaatggtggcatgaaactgtactgtcttattgtaatagccataattcttttattcaggagtgcttttttgatgatatggagagcataccagcagtga

SEQ ID NO: 4286 - DNA, 170 bp, Homo sapiens
agattcaagtaatactattcttttattttcatatattaaaaataaaaccacaatggtggcatgaaactgtactgtcttattgtaatagccataattcttttattcaggagtgcttttttgatgatatggagagcataccagcagtgactacatggaacacataccttcga

SEQ ID NO: 4287 - DNA, 170 bp, Homo sapiens
ttttcatatattaaaaataaaaccacaatggtggcatgaaactgtactgtcttattgtaatagccataattcttttattcaggagtgcttttttgatgatatggagagcataccagcagtgactacatggaacacataccttcgatatattactgtccacaagagcttaa

SEQ ID NO: 4288 - DNA, 170 bp, Homo sapiens
caatggtggcatgaaactgtactgtcttattgtaatagccataattcttttattcaggagtgcttttttgatgatatggagagcataccagcagtgactacatggaacacataccttcgatatattactgtccacaagagcttaatttttgtgctaatttggtgcttagt

SEQ ID NO: 4289 - DNA, 170 bp, Homo sapiens
ttgtaatagccataattcttttattcaggagtgcttttttgatgatatggagagcataccagcagtgactacatggaacacataccttcgatatattactgtccacaagagcttaatttttgtgctaatttggtgcttagtaatttttctggcagaggtaagaatgttct

SEQ ID NO: 4290 - DNA, 170 bp, Homo sapiens
ggagtgcttttttgatgatatggagagcataccagcagtgactacatggaacacataccttcgatatattactgtccacaagagcttaatttttgtgctaatttggtgcttagtaatttttctggcagaggtaagaatgttctattgtaaagtattactggatttaaagt

SEQ ID NO: 4291 - DNA, 170 bp, Homo sapiens
gagcataccagcagtgactacatggaacacataccttcgatatattactgtccacaagagcttaatttttgtgctaatttggtgcttagtaatttttctggcagaggtaagaatgttctattgtaaagtattactggatttaaagttaaattaagatagtttggggatgt

SEQ ID NO: 4292 - DNA, 170 bp, Homo sapiens
tggaacacataccttcgatatattactgtccacaagagcttaatttttgtgctaatttggtgcttagtaatttttctggcagaggtaagaatgttctattgtaaagtattactggatttaaagttaaattaagatagtttggggatgtatacatatatatgcacacacat

SEQ ID NO: 4293 - DNA, 170 bp, Homo sapiens
gtccacaagagcttaatttttgtgctaatttggtgcttagtaatttttctggcagaggtaagaatgttctattgtaaagtattactggatttaaagttaaattaagatagtttggggatgtatacatatatatgcacacacataaatatgtatatatacacatgtataca

SEQ ID NO: 4294 - DNA, 170 bp, Homo sapiens
aatttggtgcttagtaatttttctggcagaggtaagaatgttctattgtaaagtattactggatttaaagttaaattaagatagtttggggatgtatacatatatatgcacacacataaatatgtatatatacacatgtatacatgtataagtatgcatatatacacaca

SEQ ID NO: 4295 - DNA, 170 bp, Homo sapiens
cccaggaacacaaagcaaaggaagatgaaattgtgtgtaccttgatattggtacacacatcaaatggtgtgatgtgaatttagatgtgggcatgggaggaataggtgaagatgttagaaaaaaaatcaactgtgtcttgttccattccaggtggctgcttctttggttgt

SEQ ID NO: 4296 - DNA, 170 bp, Homo sapiens
tgaaattgtgtgtaccttgatattggtacacacatcaaatggtgtgatgtgaatttagatgtgggcatgggaggaataggtgaagatgttagaaaaaaaatcaactgtgtcttgttccattccaggtggctgcttctttggttgtgctgtggctccttggaaagtgagta

SEQ ID NO: 4297 - DNA, 170 bp, Homo sapiens
acacacatcaaatggtgtgatgtgaatttagatgtgggcatgggaggaataggtgaagatgttagaaaaaaaatcaactgtgtcttgttccattccaggtggctgcttctttggttgtgctgtggctccttggaaagtgagtattccatgtcctattgtgtagattgtgt

SEQ ID NO: 4298 - DNA, 170 bp, Homo sapiens
ttagatgtgggcatgggaggaataggtgaagatgttagaaaaaaaatcaactgtgtcttgttccattccaggtggctgcttctttggttgtgctgtggctccttggaaagtgagtattccatgtcctattgtgtagattgtgttttatttctgttgattaaatattgtaa

SEQ ID NO: 4299 - DNA, 170 bp, Homo sapiens
aggtgaagatgttagaaaaaaaatcaactgtgtcttgttccattccaggtggctgcttctttggttgtgctgtggctccttggaaagtgagtattccatgtcctattgtgtagattgtgttttatttctgttgattaaatattgtaatccactatgtttgtatgtattgt

SEQ ID NO: 4300 - DNA, 170 bp, Homo sapiens
caactgtgtcttgttccattccaggtggctgcttctttggttgtgctgtggctccttggaaagtgagtattccatgtcctattgtgtagattgtgttttatttctgttgattaaatattgtaatccactatgtttgtatgtattgtaatccactttgtttcatttctccc

SEQ ID NO: 4301 - DNA, 170 bp, Homo sapiens
gctgcttctttggttgtgctgtggctccttggaaagtgagtattccatgtcctattgtgtagattgtgttttatttctgttgattaaatattgtaatccactatgtttgtatgtattgtaatccactttgtttcatttctcccaagcattatggtagtggaaagataagg

SEQ ID NO: 4302 - DNA, 170 bp, Homo sapiens
aggttaagggtgcatgctcttctaatgcaaaatattgtatttatttagactcaagtttagttccatttacatgtattggaaattcagtaagtaactttggctgccaaataacgatttcctatttgctttacagcactcctcttcaagacaaagggaatagtactcatagt

SEQ ID NO: 4303 - DNA, 170 bp, Homo sapiens
ctaatgcaaaatattgtatttatttagactcaagtttagttccatttacatgtattggaaattcagtaagtaactttggctgccaaataacgatttcctatttgctttacagcactcctcttcaagacaaagggaatagtactcatagtagaaataacagctatgcagtg

SEQ ID NO: 4304 - DNA, 170 bp, Homo sapiens
actttgcttgctatgggattcttcagaggtctaccactggtgcatactctaatcacagtgtcgaaaattttacaccacaaaatgttacattctgttcttcaagcacctatgtcaaccctcaacacgttgaaagcaggtactttactaggtctaagaaatgaaactgctga

SEQ ID NO: 4305 - DNA, 170 bp, Homo sapiens
agaggtctaccactggtgcatactctaatcacagtgtcgaaaattttacaccacaaaatgttacattctgttcttcaagcacctatgtcaaccctcaacacgttgaaagcaggtactttactaggtctaagaaatgaaactgctgatccaccatcaatagggcctgtggt

SEQ ID NO: 4306 - DNA, 170 bp, Homo sapiens
tcacagtgtcgaaaattttacaccacaaaatgttacattctgttcttcaagcacctatgtcaaccctcaacacgttgaaagcaggtactttactaggtctaagaaatgaaactgctgatccaccatcaatagggcctgtggttttgttggttttctaatggcagtgctgg

SEQ ID NO: 4307 - DNA, 170 bp, Homo sapiens
caccacaaaatgttacattctgttcttcaagcacctatgtcaaccctcaacacgttgaaagcaggtactttactaggtctaagaaatgaaactgctgatccaccatcaatagggcctgtggttttgttggttttctaatggcagtgctggcttttgcacagaggcatgtg

SEQ ID NO: 4308 - DNA, 170 bp, Homo sapiens
agcacctatgtcaaccctcaacacgttgaaagcaggtactttactaggtctaagaaatgaaactgctgatccaccatcaatagggcctgtggttttgttggttttctaatggcagtgctggcttttgcacagaggcatgtgccctttgttgaacctccatttgactggca

SEQ ID NO: 4309 - DNA, 170 bp, Homo sapiens
agactcaagtttagttccatttacatgtattggaaattcagtaagtaactttggctgccaaataacgatttcctatttgctttacagcactcctcttcaagacaaagggaatagtactcatagtagaaataacagctatgcagtgattatcaccagcaccagttcgtatt

SEQ ID NO: 4310 - DNA, 170 bp, Homo sapiens
tgtattggaaattcagtaagtaactttggctgccaaataacgatttcctatttgctttacagcactcctcttcaagacaaagggaatagtactcatagtagaaataacagctatgcagtgattatcaccagcaccagttcgtattatgtgttttacatttacgtgggagt

SEQ ID NO: 4311 - DNA, 170 bp, Homo sapiens
ttggctgccaaataacgatttcctatttgctttacagcactcctcttcaagacaaagggaatagtactcatagtagaaataacagctatgcagtgattatcaccagcaccagttcgtattatgtgttttacatttacgtgggagtagccgacactttgcttgctatggga

SEQ ID NO: 4312 - DNA, 170 bp, Homo sapiens
ttgctttacagcactcctcttcaagacaaagggaatagtactcatagtagaaataacagctatgcagtgattatcaccagcaccagttcgtattatgtgttttacatttacgtgggagtagccgacactttgcttgctatgggattcttcagaggtctaccactggtgca

SEQ ID NO: 4313 - DNA, 170 bp, Homo sapiens
agacaaagggaatagtactcatagtagaaataacagctatgcagtgattatcaccagcaccagttcgtattatgtgttttacatttacgtgggagtagccgacactttgcttgctatgggattcttcagaggtctaccactggtgcatactctaatcacagtgtcgaaaa

SEQ ID NO: 4314 - DNA, 170 bp, Homo sapiens
aacagctatgcagtgattatcaccagcaccagttcgtattatgtgttttacatttacgtgggagtagccgacactttgcttgctatgggattcttcagaggtctaccactggtgcatactctaatcacagtgtcgaaaattttacaccacaaaatgttacattctgttct

SEQ ID NO: 4315 - DNA, 170 bp, Homo sapiens
caccagttcgtattatgtgttttacatttacgtgggagtagccgacactttgcttgctatgggattcttcagaggtctaccactggtgcatactctaatcacagtgtcgaaaattttacaccacaaaatgttacattctgttcttcaagcacctatgtcaaccctcaaca

SEQ ID NO: 4316 - DNA, 170 bp, Homo sapiens
acatttacgtgggagtagccgacactttgcttgctatgggattcttcagaggtctaccactggtgcatactctaatcacagtgtcgaaaattttacaccacaaaatgttacattctgttcttcaagcacctatgtcaaccctcaacacgttgaaagcaggtactttacta

SEQ ID NO: 4317 - DNA, 170 bp, Homo sapiens
aatttctaagtctatctgattctatttgctaattcttatttgggttctgaatgcgtctactgtgatccaaacttagtattgaatatattgatatatctttaaaaaattagtgttttttgaggaatttgtcatcttgtatattataggtgggattcttaatagattctcca

SEQ ID NO: 4318 - DNA, 170 bp, Homo sapiens
ttgctaattcttatttgggttctgaatgcgtctactgtgatccaaacttagtattgaatatattgatatatctttaaaaaattagtgttttttgaggaatttgtcatcttgtatattataggtgggattcttaatagattctccaaagatatagcaattttggatgacct

SEQ ID NO: 4319 - DNA, 170 bp, Homo sapiens
tctactgtgatccaaacttagtattgaatatattgatatatctttaaaaaattagtgttttttgaggaatttgtcatcttgtatattataggtgggattcttaatagattctccaaagatatagcaattttggatgaccttctgcctcttaccatatttgacttcatcca

SEQ ID NO: 4320 - DNA, 170 bp, Homo sapiens
tattgaatatattgatatatctttaaaaaattagtgttttttgaggaatttgtcatcttgtatattataggtgggattcttaatagattctccaaagatatagcaattttggatgaccttctgcctcttaccatatttgacttcatccaggtatgtaaaaataagtaccg

SEQ ID NO: 4321 - DNA, 170 bp, Homo sapiens
aaaaaattagtgttttttgaggaatttgtcatcttgtatattataggtgggattcttaatagattctccaaagatatagcaattttggatgaccttctgcctcttaccatatttgacttcatccaggtatgtaaaaataagtaccgttaagtatgtctgtattattaaaa

SEQ ID NO: 4322 - DNA, 170 bp, Homo sapiens
tttgtcatcttgtatattataggtgggattcttaatagattctccaaagatatagcaattttggatgaccttctgcctcttaccatatttgacttcatccaggtatgtaaaaataagtaccgttaagtatgtctgtattattaaaaaaacaataacaaaagcaaatgtga

SEQ ID NO: 4323 - DNA, 170 bp, Homo sapiens
tcttaatagattctccaaagatatagcaattttggatgaccttctgcctcttaccatatttgacttcatccaggtatgtaaaaataagtaccgttaagtatgtctgtattattaaaaaaacaataacaaaagcaaatgtgattttgttttcattttttatttgattgagg

SEQ ID NO: 4324 - DNA, 170 bp, Homo sapiens
tatagcaattttggatgaccttctgcctcttaccatatttgacttcatccaggtatgtaaaaataagtaccgttaagtatgtctgtattattaaaaaaacaataacaaaagcaaatgtgattttgttttcattttttatttgattgagggttgaagtcctgtctattgca

SEQ ID NO: 4325 - DNA, 170 bp, Homo sapiens
gcctcttaccatatttgacttcatccaggtatgtaaaaataagtaccgttaagtatgtctgtattattaaaaaaacaataacaaaagcaaatgtgattttgttttcattttttatttgattgagggttgaagtcctgtctattgcattaattttgtaattatccaaagcc

SEQ ID NO: 4326 - DNA, 170 bp, Homo sapiens
aaaaaaaataaaaaaaagtttgaggtgtttaaagtatgcaaaaaaaaaaaaagaaataaatcactgacacactttgtccactttgcaatgtgaaaatgtttactcaccaacatgttttctttgatcttacagttgttattaattgtgattggagctatagcagttgtcgc

SEQ ID NO: 4327 - DNA, 170 bp, Homo sapiens
gtgtttaaagtatgcaaaaaaaaaaaaagaaataaatcactgacacactttgtccactttgcaatgtgaaaatgtttactcaccaacatgttttctttgatcttacagttgttattaattgtgattggagctatagcagttgtcgcagttttacaaccctacatctttgt

SEQ ID NO: 4328 - DNA, 170 bp, Homo sapiens
acagcaactcaaacaactggaatctgaaggtatgacagtgaatgtgcgatactcatcttgtaaaaaagctataagagctatttgagattctttattgttaatctacttaaaaaaaattctgcttttaaacttttacatcatataacaataatttttttctacatgcatgt

SEQ ID NO: 4329 - DNA, 170 bp, Homo sapiens
aaagaaataaatcactgacacactttgtccactttgcaatgtgaaaatgtttactcaccaacatgttttctttgatcttacagttgttattaattgtgattggagctatagcagttgtcgcagttttacaaccctacatctttgttgcaacagtgccagtgatagtggct

SEQ ID NO: 4330 - DNA, 170 bp, Homo sapiens
ccactttgcaatgtgaaaatgtttactcaccaacatgttttctttgatcttacagttgttattaattgtgattggagctatagcagttgtcgcagttttacaaccctacatctttgttgcaacagtgccagtgatagtggcttttattatgttgagagcatatttcctcc

SEQ ID NO: 4331 - DNA, 170 bp, Homo sapiens
actcaccaacatgttttctttgatcttacagttgttattaattgtgattggagctatagcagttgtcgcagttttacaaccctacatctttgttgcaacagtgccagtgatagtggcttttattatgttgagagcatatttcctccaaacctcacagcaactcaaacaac

SEQ ID NO: 4332 - DNA, 170 bp, Homo sapiens
cttacagttgttattaattgtgattggagctatagcagttgtcgcagttttacaaccctacatctttgttgcaacagtgccagtgatagtggcttttattatgttgagagcatatttcctccaaacctcacagcaactcaaacaactggaatctgaaggtatgacagtga

SEQ ID NO: 4333 - DNA, 170 bp, Homo sapiens
gctatagcagttgtcgcagttttacaaccctacatctttgttgcaacagtgccagtgatagtggcttttattatgttgagagcatatttcctccaaacctcacagcaactcaaacaactggaatctgaaggtatgacagtgaatgtgcgatactcatcttgtaaaaaagc

SEQ ID NO: 4334 - DNA, 170 bp, Homo sapiens
acaaccctacatctttgttgcaacagtgccagtgatagtggcttttattatgttgagagcatatttcctccaaacctcacagcaactcaaacaactggaatctgaaggtatgacagtgaatgtgcgatactcatcttgtaaaaaagctataagagctatttgagattctt

SEQ ID NO: 4335 - DNA, 170 bp, Homo sapiens
gccagtgatagtggcttttattatgttgagagcatatttcctccaaacctcacagcaactcaaacaactggaatctgaaggtatgacagtgaatgtgcgatactcatcttgtaaaaaagctataagagctatttgagattctttattgttaatctacttaaaaaaaattc

SEQ ID NO: 4336 - DNA, 170 bp, Homo sapiens
tgttgagagcatatttcctccaaacctcacagcaactcaaacaactggaatctgaaggtatgacagtgaatgtgcgatactcatcttgtaaaaaagctataagagctatttgagattctttattgttaatctacttaaaaaaaattctgcttttaaacttttacatcata

SEQ ID NO: 4337 - DNA, 170 bp, Homo sapiens
tagaaattgacttattttattctcatatttacatgtgcataattttccatatgccagaaaagttgaatagtatcagattccaaatctgtatggagaccaaatcaagtgaatatctgttcctcctctctttattttagctggaccagaccaattttgaggaaaggatacag

SEQ ID NO: 4338 - DNA, 170 bp, Homo sapiens
catatttacatgtgcataattttccatatgccagaaaagttgaatagtatcagattccaaatctgtatggagaccaaatcaagtgaatatctgttcctcctctctttattttagctggaccagaccaattttgaggaaaggatacagacagcgcctggaattgtcagaca

SEQ ID NO: 4339 - DNA, 170 bp, Homo sapiens
tgccagaaaagttgaatagtatcagattccaaatctgtatggagaccaaatcaagtgaatatctgttcctcctctctttattttagctggaccagaccaattttgaggaaaggatacagacagcgcctggaattgtcagacatataccaaatcccttctgttgattctgc

SEQ ID NO: 4340 - DNA, 170 bp, Homo sapiens
tccaaatctgtatggagaccaaatcaagtgaatatctgttcctcctctctttattttagctggaccagaccaattttgaggaaaggatacagacagcgcctggaattgtcagacatataccaaatcccttctgttgattctgctgacaatctatctgaaaaattggaaag

SEQ ID NO: 4341 - DNA, 170 bp, Homo sapiens
tcaagtgaatatctgttcctcctctctttattttagctggaccagaccaattttgaggaaaggatacagacagcgcctggaattgtcagacatataccaaatcccttctgttgattctgctgacaatctatctgaaaaattggaaaggtatgttcatgtacattgtttag

SEQ ID NO: 4342 - DNA, 170 bp, Homo sapiens
tttattttagctggaccagaccaattttgaggaaaggatacagacagcgcctggaattgtcagacatataccaaatcccttctgttgattctgctgacaatctatctgaaaaattggaaaggtatgttcatgtacattgtttagttgaagagagaaattcatattattaa

SEQ ID NO: 4343 - DNA, 170 bp, Homo sapiens
aggaaaggatacagacagcgcctggaattgtcagacatataccaaatcccttctgttgattctgctgacaatctatctgaaaaattggaaaggtatgttcatgtacattgtttagttgaagagagaaattcatattattaattatttagagaagagaaagcaaacatatt

SEQ ID NO: 4344 - DNA, 170 bp, Homo sapiens
gcctggaattgtcagacatataccaaatcccttctgttgattctgctgacaatctatctgaaaaattggaaaggtatgttcatgtacattgtttagttgaagagagaaattcatattattaattatttagagaagagaaagcaaacatattataagtttaattcttatat

SEQ ID NO: 4345 - DNA, 170 bp, Homo sapiens
tcccttctgttgattctgctgacaatctatctgaaaaattggaaaggtatgttcatgtacattgtttagttgaagagagaaattcatattattaattatttagagaagagaaagcaaacatattataagtttaattcttatatttaaaaataggagccaagtatggtggc

SEQ ID NO: 4346 - DNA, 170 bp, Homo sapiens
gacaatctatctgaaaaattggaaaggtatgttcatgtacattgtttagttgaagagagaaattcatattattaattatttagagaagagaaagcaaacatattataagtttaattcttatatttaaaaataggagccaagtatggtggctaatgcctgtaatcccaact

SEQ ID NO: 4347 - DNA, 170 bp, Homo sapiens
gtgaaaaaaagctttttaaccaatgacatttgtgatatgattattctaatttagtctttttcaggtacaagatattatgaaattacattttgtgtttatgttatttgcaatgttttctatggaaatatttcacaggcaggagtccaattttcactcatcttgttacaagc

SEQ ID NO: 4348 - DNA, 170 bp, Homo sapiens
tgacatttgtgatatgattattctaatttagtctttttcaggtacaagatattatgaaattacattttgtgtttatgttatttgcaatgttttctatggaaatatttcacaggcaggagtccaattttcactcatcttgttacaagcttaaaaggactatggacacttcg

SEQ ID NO: 4349 - DNA, 170 bp, Homo sapiens
tgccaactggttcttgtacctgtcaacactgcgctggttccaaatgagaatagaaatgatttttgtcatcttcttcattgctgttaccttcatttccattttaacaacaggtactatgaactcattaactttagctaagcatttaagtaaaaaattttcaatgaataaaa

SEQ ID NO: 4350 - DNA, 170 bp, Homo sapiens
ctgcgctggttccaaatgagaatagaaatgatttttgtcatcttcttcattgctgttaccttcatttccattttaacaacaggtactatgaactcattaactttagctaagcatttaagtaaaaaattttcaatgaataaaatgctgcattctataggttatcaattttt

SEQ ID NO: 4351 - DNA, 170 bp, Homo sapiens
aatagaaatgatttttgtcatcttcttcattgctgttaccttcatttccattttaacaacaggtactatgaactcattaactttagctaagcatttaagtaaaaaattttcaatgaataaaatgctgcattctataggttatcaatttttgatatctttagagtttagta

SEQ ID NO: 4352 - DNA, 170 bp, Homo sapiens
cttcattgctgttaccttcatttccattttaacaacaggtactatgaactcattaactttagctaagcatttaagtaaaaaattttcaatgaataaaatgctgcattctataggttatcaatttttgatatctttagagtttagtaattaacaaatttgttggtttatta

SEQ ID NO: 4353 - DNA, 170 bp, Homo sapiens
tttagtctttttcaggtacaagatattatgaaattacattttgtgtttatgttatttgcaatgttttctatggaaatatttcacaggcaggagtccaattttcactcatcttgttacaagcttaaaaggactatggacacttcgtgccttcggacggcagccttactttg

SEQ ID NO: 4354 - DNA, 170 bp, Homo sapiens
ttatgaaattacattttgtgtttatgttatttgcaatgttttctatggaaatatttcacaggcaggagtccaattttcactcatcttgttacaagcttaaaaggactatggacacttcgtgccttcggacggcagccttactttgaaactctgttccacaaagctctgaa

SEQ ID NO: 4355 - DNA, 170 bp, Homo sapiens
tgttatttgcaatgttttctatggaaatatttcacaggcaggagtccaattttcactcatcttgttacaagcttaaaaggactatggacacttcgtgccttcggacggcagccttactttgaaactctgttccacaaagctctgaatttacatactgccaactggttctt

SEQ ID NO: 4356 - DNA, 170 bp, Homo sapiens
tatttcacaggcaggagtccaattttcactcatcttgttacaagcttaaaaggactatggacacttcgtgccttcggacggcagccttactttgaaactctgttccacaaagctctgaatttacatactgccaactggttcttgtacctgtcaacactgcgctggttcca

SEQ ID NO: 4357 - DNA, 170 bp, Homo sapiens
cactcatcttgttacaagcttaaaaggactatggacacttcgtgccttcggacggcagccttactttgaaactctgttccacaaagctctgaatttacatactgccaactggttcttgtacctgtcaacactgcgctggttccaaatgagaatagaaatgatttttgtca

SEQ ID NO: 4358 - DNA, 170 bp, Homo sapiens
aggactatggacacttcgtgccttcggacggcagccttactttgaaactctgttccacaaagctctgaatttacatactgccaactggttcttgtacctgtcaacactgcgctggttccaaatgagaatagaaatgatttttgtcatcttcttcattgctgttaccttca

SEQ ID NO: 4359 - DNA, 170 bp, Homo sapiens
acggcagccttactttgaaactctgttccacaaagctctgaatttacatactgccaactggttcttgtacctgtcaacactgcgctggttccaaatgagaatagaaatgatttttgtcatcttcttcattgctgttaccttcatttccattttaacaacaggtactatga

SEQ ID NO: 4360 - DNA, 170 bp, Homo sapiens
ctgttccacaaagctctgaatttacatactgccaactggttcttgtacctgtcaacactgcgctggttccaaatgagaatagaaatgatttttgtcatcttcttcattgctgttaccttcatttccattttaacaacaggtactatgaactcattaactttagctaagca

SEQ ID NO: 4361 - DNA, 170 bp, Homo sapiens
gatttaaaaattgttaaaattagcataaaattgaaatgtaaatttaatgtgatatgtgccctaggagaagtgtgaataaagtcgttcacagaagagagaaataacatgaggttcatttacgtcttttgtgcatctataggagaaggagaaggaagagttggtattatcct

SEQ ID NO: 4362 - DNA, 170 bp, Homo sapiens
tagcataaaattgaaatgtaaatttaatgtgatatgtgccctaggagaagtgtgaataaagtcgttcacagaagagagaaataacatgaggttcatttacgtcttttgtgcatctataggagaaggagaaggaagagttggtattatcctgactttagccatgaatatca

SEQ ID NO: 4363 - DNA, 170 bp, Homo sapiens
tttaatgtgatatgtgccctaggagaagtgtgaataaagtcgttcacagaagagagaaataacatgaggttcatttacgtcttttgtgcatctataggagaaggagaaggaagagttggtattatcctgactttagccatgaatatcatgagtacattgcagtgggctgt

SEQ ID NO: 4364 - DNA, 170 bp, Homo sapiens
agtgtgaataaagtcgttcacagaagagagaaataacatgaggttcatttacgtcttttgtgcatctataggagaaggagaaggaagagttggtattatcctgactttagccatgaatatcatgagtacattgcagtgggctgtaaactccagcatagatgtggatagct

SEQ ID NO: 4365 - DNA, 170 bp, Homo sapiens
agagaaataacatgaggttcatttacgtcttttgtgcatctataggagaaggagaaggaagagttggtattatcctgactttagccatgaatatcatgagtacattgcagtgggctgtaaactccagcatagatgtggatagcttggtaagtcttatcatctttttaact

SEQ ID NO: 4366 - DNA, 170 bp, Homo sapiens
cgtcttttgtgcatctataggagaaggagaaggaagagttggtattatcctgactttagccatgaatatcatgagtacattgcagtgggctgtaaactccagcatagatgtggatagcttggtaagtcttatcatctttttaacttttatgaaaaaaattcagacaagta

SEQ ID NO: 4367 - DNA, 170 bp, Homo sapiens
ggagaaggaagagttggtattatcctgactttagccatgaatatcatgagtacattgcagtgggctgtaaactccagcatagatgtggatagcttggtaagtcttatcatctttttaacttttatgaaaaaaattcagacaagtaacaaagtatgagtaatagcatgagg

SEQ ID NO: 4368 - DNA, 170 bp, Homo sapiens
tgactttagccatgaatatcatgagtacattgcagtgggctgtaaactccagcatagatgtggatagcttggtaagtcttatcatctttttaacttttatgaaaaaaattcagacaagtaacaaagtatgagtaatagcatgaggaagaactatataccgtatattgagc

SEQ ID NO: 4369 - DNA, 170 bp, Homo sapiens
tgcagtgggctgtaaactccagcatagatgtggatagcttggtaagtcttatcatctttttaacttttatgaaaaaaattcagacaagtaacaaagtatgagtaatagcatgaggaagaactatataccgtatattgagcttaagaaataaaacattacagataaattga

SEQ ID NO: 4370 - DNA, 170 bp, Homo sapiens
tgaaaagcccgacaaataaccaagtgacaaatagcaagtgttgcattttacaagttattttttaggaagcatcaaactaattgtgaaattgtctgccattcttaaaaacaaaaatgttgttatttttatttcagatgcgatctgtgagccgagtctttaagttcattgac

SEQ ID NO: 4371 - DNA, 170 bp, Homo sapiens
tgacaaatagcaagtgttgcattttacaagttattttttaggaagcatcaaactaattgtgaaattgtctgccattcttaaaaacaaaaatgttgttatttttatttcagatgcgatctgtgagccgagtctttaagttcattgacatgccaacagaaggtaaacctacc

SEQ ID NO: 4372 - DNA, 170 bp, Homo sapiens
ttcacacgtgaagaaagatgacatctggccctcagggggccaaatgactgtcaaagatctcacagcaaaatacacagaaggtggaaatgccatattagagaacatttccttctcaataagtcctggccagagggtgagatttgaacactgcttgctttgttagactgtgt

SEQ ID NO: 4373 - DNA, 170 bp, Homo sapiens
ggccctcagggggccaaatgactgtcaaagatctcacagcaaaatacacagaaggtggaaatgccatattagagaacatttccttctcaataagtcctggccagagggtgagatttgaacactgcttgctttgttagactgtgttcagtaagtgaatcccagtagcctga

SEQ ID NO: 4374 - DNA, 170 bp, Homo sapiens
tgtcaaagatctcacagcaaaatacacagaaggtggaaatgccatattagagaacatttccttctcaataagtcctggccagagggtgagatttgaacactgcttgctttgttagactgtgttcagtaagtgaatcccagtagcctgaagcaatgtgttagcagaatcta

SEQ ID NO: 4375 - DNA, 170 bp, Homo sapiens
agaaggtggaaatgccatattagagaacatttccttctcaataagtcctggccagagggtgagatttgaacactgcttgctttgttagactgtgttcagtaagtgaatcccagtagcctgaagcaatgtgttagcagaatctatttgtaacattattattgtacagtaga

SEQ ID NO: 4376 - DNA, 170 bp, Homo sapiens
agaacatttccttctcaataagtcctggccagagggtgagatttgaacactgcttgctttgttagactgtgttcagtaagtgaatcccagtagcctgaagcaatgtgttagcagaatctatttgtaacattattattgtacagtagaatcaatattaaacacacatgttt

SEQ ID NO: 4377 - DNA, 170 bp, Homo sapiens
ttacaagttattttttaggaagcatcaaactaattgtgaaattgtctgccattcttaaaaacaaaaatgttgttatttttatttcagatgcgatctgtgagccgagtctttaagttcattgacatgccaacagaaggtaaacctaccaagtcaaccaaaccatacaagaa

SEQ ID NO: 4378 - DNA, 170 bp, Homo sapiens
caaactaattgtgaaattgtctgccattcttaaaaacaaaaatgttgttatttttatttcagatgcgatctgtgagccgagtctttaagttcattgacatgccaacagaaggtaaacctaccaagtcaaccaaaccatacaagaatggccaactctcgaaagttatgatt

SEQ ID NO: 4379 - DNA, 170 bp, Homo sapiens
gccattcttaaaaacaaaaatgttgttatttttatttcagatgcgatctgtgagccgagtctttaagttcattgacatgccaacagaaggtaaacctaccaagtcaaccaaaccatacaagaatggccaactctcgaaagttatgattattgagaattcacacgtgaaga

SEQ ID NO: 4380 - DNA, 170 bp, Homo sapiens
ttatttttatttcagatgcgatctgtgagccgagtctttaagttcattgacatgccaacagaaggtaaacctaccaagtcaaccaaaccatacaagaatggccaactctcgaaagttatgattattgagaattcacacgtgaagaaagatgacatctggccctcaggggg

SEQ ID NO: 4381 - DNA, 170 bp, Homo sapiens
agtctttaagttcattgacatgccaacagaaggtaaacctaccaagtcaaccaaaccatacaagaatggccaactctcgaaagttatgattattgagaattcacacgtgaagaaagatgacatctggccctcagggggccaaatgactgtcaaagatctcacagcaaaat

SEQ ID NO: 4382 - DNA, 170 bp, Homo sapiens
gccaacagaaggtaaacctaccaagtcaaccaaaccatacaagaatggccaactctcgaaagttatgattattgagaattcacacgtgaagaaagatgacatctggccctcagggggccaaatgactgtcaaagatctcacagcaaaatacacagaaggtggaaatgcca

SEQ ID NO: 4383 - DNA, 170 bp, Homo sapiens
gtcaaccaaaccatacaagaatggccaactctcgaaagttatgattattgagaattcacacgtgaagaaagatgacatctggccctcagggggccaaatgactgtcaaagatctcacagcaaaatacacagaaggtggaaatgccatattagagaacatttccttctcaa

SEQ ID NO: 4384 - DNA, 170 bp, Homo sapiens
ctctcgaaagttatgattattgagaattcacacgtgaagaaagatgacatctggccctcagggggccaaatgactgtcaaagatctcacagcaaaatacacagaaggtggaaatgccatattagagaacatttccttctcaataagtcctggccagagggtgagatttga

SEQ ID NO: 4385 - DNA, 170 bp, Homo sapiens
tgaataagtgaaaatcttccactggtgacaggataaaatattccaatggtttttattgaagtacaatactgaattatgtttatggcatggtacctatatgtcacagaagtgatcccatcacttttaccttataggtgggcctcttgggaagaactggatcagggaagagt

SEQ ID NO: 4386 - DNA, 170 bp, Homo sapiens
tgacaggataaaatattccaatggtttttattgaagtacaatactgaattatgtttatggcatggtacctatatgtcacagaagtgatcccatcacttttaccttataggtgggcctcttgggaagaactggatcagggaagagtactttgttatcagcttttttgagac

SEQ ID NO: 4387 - DNA, 170 bp, Homo sapiens
gcaacagtggaggaaagcctttggagtgataccacaggtgagcaaaaggacttagccagaaaaaaggcaactaaattatattttttactgctatttgatacttgtactcaagaaattcatattactctgcaaaatatatttgttatgcattgctgtcttttttctccagt

SEQ ID NO: 4388 - DNA, 170 bp, Homo sapiens
tttattgaagtacaatactgaattatgtttatggcatggtacctatatgtcacagaagtgatcccatcacttttaccttataggtgggcctcttgggaagaactggatcagggaagagtactttgttatcagcttttttgagactactgaacactgaaggagaaatccag

SEQ ID NO: 4389 - DNA, 170 bp, Homo sapiens
tgtttatggcatggtacctatatgtcacagaagtgatcccatcacttttaccttataggtgggcctcttgggaagaactggatcagggaagagtactttgttatcagcttttttgagactactgaacactgaaggagaaatccagatcgatggtgtgtcttgggattcaa

SEQ ID NO: 4390 - DNA, 170 bp, Homo sapiens
cacagaagtgatcccatcacttttaccttataggtgggcctcttgggaagaactggatcagggaagagtactttgttatcagcttttttgagactactgaacactgaaggagaaatccagatcgatggtgtgtcttgggattcaataactttgcaacagtggaggaaagc

SEQ ID NO: 4391 - DNA, 170 bp, Homo sapiens
ccttataggtgggcctcttgggaagaactggatcagggaagagtactttgttatcagcttttttgagactactgaacactgaaggagaaatccagatcgatggtgtgtcttgggattcaataactttgcaacagtggaggaaagcctttggagtgataccacaggtgagc

SEQ ID NO: 4392 - DNA, 170 bp, Homo sapiens
actggatcagggaagagtactttgttatcagcttttttgagactactgaacactgaaggagaaatccagatcgatggtgtgtcttgggattcaataactttgcaacagtggaggaaagcctttggagtgataccacaggtgagcaaaaggacttagccagaaaaaaggca

SEQ ID NO: 4393 - DNA, 170 bp, Homo sapiens
tcagcttttttgagactactgaacactgaaggagaaatccagatcgatggtgtgtcttgggattcaataactttgcaacagtggaggaaagcctttggagtgataccacaggtgagcaaaaggacttagccagaaaaaaggcaactaaattatattttttactgctattt

SEQ ID NO: 4394 - DNA, 170 bp, Homo sapiens
cactgaaggagaaatccagatcgatggtgtgtcttgggattcaataactttgcaacagtggaggaaagcctttggagtgataccacaggtgagcaaaaggacttagccagaaaaaaggcaactaaattatattttttactgctatttgatacttgtactcaagaaattca

SEQ ID NO: 4395 - DNA, 170 bp, Homo sapiens
ggtgtgtcttgggattcaataactttgcaacagtggaggaaagcctttggagtgataccacaggtgagcaaaaggacttagccagaaaaaaggcaactaaattatattttttactgctatttgatacttgtactcaagaaattcatattactctgcaaaatatatttgtt

SEQ ID NO: 4396 - DNA, 170 bp, Homo sapiens
aagtacatgggtgtttcttattttaaaataatttttctacttgaaatattttacaatacaataagggaaaaataaaaagttatttaagttattcatactttcttcttcttttcttttttgctatagaaagtatttattttttctggaacatttagaaaaaacttggatcc

SEQ ID NO: 4397 - DNA, 170 bp, Homo sapiens
taaaataatttttctacttgaaatattttacaatacaataagggaaaaataaaaagttatttaagttattcatactttcttcttcttttcttttttgctatagaaagtatttattttttctggaacatttagaaaaaacttggatccctatgaacagtggagtgatcaag

SEQ ID NO: 4398 - DNA, 170 bp, Homo sapiens
ttttacaatacaataagggaaaaataaaaagttatttaagttattcatactttcttcttcttttcttttttgctatagaaagtatttattttttctggaacatttagaaaaaacttggatccctatgaacagtggagtgatcaagaaatatggaaagttgcagatgaggt

SEQ ID NO: 4399 - DNA, 170 bp, Homo sapiens
aaaagttatttaagttattcatactttcttcttcttttcttttttgctatagaaagtatttattttttctggaacatttagaaaaaacttggatccctatgaacagtggagtgatcaagaaatatggaaagttgcagatgaggtaaggctgctaactgaaatgattttga

SEQ ID NO: 4400 - DNA, 170 bp, Homo sapiens
ctttcttcttcttttcttttttgctatagaaagtatttattttttctggaacatttagaaaaaacttggatccctatgaacagtggagtgatcaagaaatatggaaagttgcagatgaggtaaggctgctaactgaaatgattttgaaaggggtaactcataccaacaca

SEQ ID NO: 4401 - DNA, 170 bp, Homo sapiens
agaaagtatttattttttctggaacatttagaaaaaacttggatccctatgaacagtggagtgatcaagaaatatggaaagttgcagatgaggtaaggctgctaactgaaatgattttgaaaggggtaactcataccaacacaaatggctgatatagctgacatcattct

SEQ ID NO: 4402 - DNA, 170 bp, Homo sapiens
tttagaaaaaacttggatccctatgaacagtggagtgatcaagaaatatggaaagttgcagatgaggtaaggctgctaactgaaatgattttgaaaggggtaactcataccaacacaaatggctgatatagctgacatcattctacacactttgtgtgcatgtatgtgtg

SEQ ID NO: 4403 - DNA, 170 bp, Homo sapiens
acagtggagtgatcaagaaatatggaaagttgcagatgaggtaaggctgctaactgaaatgattttgaaaggggtaactcataccaacacaaatggctgatatagctgacatcattctacacactttgtgtgcatgtatgtgtgtgcacaactttaaaatggagtaccct

SEQ ID NO: 4404 - DNA, 170 bp, Homo sapiens
ctcaatcaattcaaatggtggcaggtagtgggggtagagggattggtatgaaaaacataagctttcagaactcctgtgtttatttttagaatgtcaactgcttgagtgtttttaactctgtggtatctgaactatcttctctaactgcaggttgggctcagatctgtgat

SEQ ID NO: 4405 - DNA, 170 bp, Homo sapiens
agtgggggtagagggattggtatgaaaaacataagctttcagaactcctgtgtttatttttagaatgtcaactgcttgagtgtttttaactctgtggtatctgaactatcttctctaactgcaggttgggctcagatctgtgatagaacagtttcctgggaagcttgact

SEQ ID NO: 4406 - DNA, 170 bp, Homo sapiens
gcttggctagatctgttctcagtaaggcgaagatcttgctgcttgatgaacccagtgctcatttggatccagtgtgagtttcagatgttctgttacttaatagcacagtgggaacagaatcattatgcctgcttcatggtgacacatatttctattaggctgtcatgtct

SEQ ID NO: 4407 - DNA, 170 bp, Homo sapiens
aaggcgaagatcttgctgcttgatgaacccagtgctcatttggatccagtgtgagtttcagatgttctgttacttaatagcacagtgggaacagaatcattatgcctgcttcatggtgacacatatttctattaggctgtcatgtctgcgtgtgggggtctcccccaaga

SEQ ID NO: 4408 - DNA, 170 bp, Homo sapiens
cccagtgctcatttggatccagtgtgagtttcagatgttctgttacttaatagcacagtgggaacagaatcattatgcctgcttcatggtgacacatatttctattaggctgtcatgtctgcgtgtgggggtctcccccaagatatgaaataattgcccagtggaaatga

SEQ ID NO: 4409 - DNA, 170 bp, Homo sapiens
tgaaaaacataagctttcagaactcctgtgtttatttttagaatgtcaactgcttgagtgtttttaactctgtggtatctgaactatcttctctaactgcaggttgggctcagatctgtgatagaacagtttcctgggaagcttgactttgtccttgtggatgggggctg

SEQ ID NO: 4410 - DNA, 170 bp, Homo sapiens
cctgtgtttatttttagaatgtcaactgcttgagtgtttttaactctgtggtatctgaactatcttctctaactgcaggttgggctcagatctgtgatagaacagtttcctgggaagcttgactttgtccttgtggatgggggctgtgtcctaagccatggccacaagca

SEQ ID NO: 4411 - DNA, 170 bp, Homo sapiens
gcttgagtgtttttaactctgtggtatctgaactatcttctctaactgcaggttgggctcagatctgtgatagaacagtttcctgggaagcttgactttgtccttgtggatgggggctgtgtcctaagccatggccacaagcagttgatgtgcttggctagatctgttct

SEQ ID NO: 4412 - DNA, 170 bp, Homo sapiens
tctgaactatcttctctaactgcaggttgggctcagatctgtgatagaacagtttcctgggaagcttgactttgtccttgtggatgggggctgtgtcctaagccatggccacaagcagttgatgtgcttggctagatctgttctcagtaaggcgaagatcttgctgcttg

SEQ ID NO: 4413 - DNA, 170 bp, Homo sapiens
gttgggctcagatctgtgatagaacagtttcctgggaagcttgactttgtccttgtggatgggggctgtgtcctaagccatggccacaagcagttgatgtgcttggctagatctgttctcagtaaggcgaagatcttgctgcttgatgaacccagtgctcatttggatcc

SEQ ID NO: 4414 - DNA, 170 bp, Homo sapiens
ttcctgggaagcttgactttgtccttgtggatgggggctgtgtcctaagccatggccacaagcagttgatgtgcttggctagatctgttctcagtaaggcgaagatcttgctgcttgatgaacccagtgctcatttggatccagtgtgagtttcagatgttctgttactt

SEQ ID NO: 4415 - DNA, 170 bp, Homo sapiens
ttgtggatgggggctgtgtcctaagccatggccacaagcagttgatgtgcttggctagatctgttctcagtaaggcgaagatcttgctgcttgatgaacccagtgctcatttggatccagtgtgagtttcagatgttctgttacttaatagcacagtgggaacagaatca

SEQ ID NO: 4416 - DNA, 170 bp, Homo sapiens
gccatggccacaagcagttgatgtgcttggctagatctgttctcagtaaggcgaagatcttgctgcttgatgaacccagtgctcatttggatccagtgtgagtttcagatgttctgttacttaatagcacagtgggaacagaatcattatgcctgcttcatggtgacaca

SEQ ID NO: 4417 - DNA, 170 bp, Homo sapiens
ctatatcaacattatgtgaaaagaacttaaagaaataagtaatttaaagagataatagaacaatagacatattatcaaggtaaatacagatcattactgttctgtgatattatgtgtggtattttctttcttttctagaacataccaaataattagaagaactctaaaac

SEQ ID NO: 4418 - DNA, 170 bp, Homo sapiens
gaacttaaagaaataagtaatttaaagagataatagaacaatagacatattatcaaggtaaatacagatcattactgttctgtgatattatgtgtggtattttctttcttttctagaacataccaaataattagaagaactctaaaacaagcatttgctgattgcacagt

SEQ ID NO: 4419 - DNA, 170 bp, Homo sapiens
agataatagaacaatagacatattatcaaggtaaatacagatcattactgttctgtgatattatgtgtggtattttctttcttttctagaacataccaaataattagaagaactctaaaacaagcatttgctgattgcacagtaattctctgtgaacacaggatagaagc

SEQ ID NO: 4420 - DNA, 170 bp, Homo sapiens
caaggtaaatacagatcattactgttctgtgatattatgtgtggtattttctttcttttctagaacataccaaataattagaagaactctaaaacaagcatttgctgattgcacagtaattctctgtgaacacaggatagaagcaatgctggaatgccaacaatttttgg

SEQ ID NO: 4421 - DNA, 170 bp, Homo sapiens
tctgtgatattatgtgtggtattttctttcttttctagaacataccaaataattagaagaactctaaaacaagcatttgctgattgcacagtaattctctgtgaacacaggatagaagcaatgctggaatgccaacaatttttggtgagtctttataactttacttaaga

SEQ ID NO: 4422 - DNA, 170 bp, Homo sapiens
tctttcttttctagaacataccaaataattagaagaactctaaaacaagcatttgctgattgcacagtaattctctgtgaacacaggatagaagcaatgctggaatgccaacaatttttggtgagtctttataactttacttaagatctcattgcccttgtaattcttga

SEQ ID NO: 4423 - DNA, 170 bp, Homo sapiens
ttagaagaactctaaaacaagcatttgctgattgcacagtaattctctgtgaacacaggatagaagcaatgctggaatgccaacaatttttggtgagtctttataactttacttaagatctcattgcccttgtaattcttgataacaatctcacatgtgatagttcctgc

SEQ ID NO: 4424 - DNA, 170 bp, Homo sapiens
ttgctgattgcacagtaattctctgtgaacacaggatagaagcaatgctggaatgccaacaatttttggtgagtctttataactttacttaagatctcattgcccttgtaattcttgataacaatctcacatgtgatagttcctgcaaattgcaacaatgtacaagttct

SEQ ID NO: 4425 - DNA, 170 bp, Homo sapiens
gaacacaggatagaagcaatgctggaatgccaacaatttttggtgagtctttataactttacttaagatctcattgcccttgtaattcttgataacaatctcacatgtgatagttcctgcaaattgcaacaatgtacaagttcttttcaaaaatatgtatcatacagcca

SEQ ID NO: 4426 - DNA, 170 bp, Homo sapiens
tgtgacatacctgattgttcaaaatgcaaggctctggacattgcattctttgacttttattttcctttgagcctgtgccagtttctgtccctgctctggtctgacctgccttctgtcccagatctcactaacagccatttccctaggtcatagaagagaacaaagtgcgg

SEQ ID NO: 4427 - DNA, 170 bp, Homo sapiens
tgcaaggctctggacattgcattctttgacttttattttcctttgagcctgtgccagtttctgtccctgctctggtctgacctgccttctgtcccagatctcactaacagccatttccctaggtcatagaagagaacaaagtgcggcagtacgattccatccagaaactg

SEQ ID NO: 4428 - DNA, 170 bp, Homo sapiens
gctctttccccaccggaactcaagcaagtgcaagtctaagccccagattgctgctctgaaagaggagacagaagaagaggtgcaagatacaaggctttagagagcagcataaatgttgacatgggacatttgctcatggaattggagctcgtgggacagtcacctcatgg

SEQ ID NO: 4429 - DNA, 170 bp, Homo sapiens
aagtgcaagtctaagccccagattgctgctctgaaagaggagacagaagaagaggtgcaagatacaaggctttagagagcagcataaatgttgacatgggacatttgctcatggaattggagctcgtgggacagtcacctcatggaattggagctcgtggaacagttacc

SEQ ID NO: 4430 - DNA, 170 bp, Homo sapiens
gctgctctgaaagaggagacagaagaagaggtgcaagatacaaggctttagagagcagcataaatgttgacatgggacatttgctcatggaattggagctcgtgggacagtcacctcatggaattggagctcgtggaacagttacctctgcctcagaaaacaaggatgaa

SEQ ID NO: 4431 - DNA, 170 bp, Homo sapiens
aggtgcaagatacaaggctttagagagcagcataaatgttgacatgggacatttgctcatggaattggagctcgtgggacagtcacctcatggaattggagctcgtggaacagttacctctgcctcagaaaacaaggatgaattaagtttttttttaaaaaagaaacatt

SEQ ID NO: 4432 - DNA, 170 bp, Homo sapiens
gcattctttgacttttattttcctttgagcctgtgccagtttctgtccctgctctggtctgacctgccttctgtcccagatctcactaacagccatttccctaggtcatagaagagaacaaagtgcggcagtacgattccatccagaaactgctgaacgagaggagcctc

SEQ ID NO: 4433 - DNA, 170 bp, Homo sapiens
gcctgtgccagtttctgtccctgctctggtctgacctgccttctgtcccagatctcactaacagccatttccctaggtcatagaagagaacaaagtgcggcagtacgattccatccagaaactgctgaacgagaggagcctcttccggcaagccatcagcccctccgaca

SEQ ID NO: 4434 - DNA, 170 bp, Homo sapiens
tctggtctgacctgccttctgtcccagatctcactaacagccatttccctaggtcatagaagagaacaaagtgcggcagtacgattccatccagaaactgctgaacgagaggagcctcttccggcaagccatcagcccctccgacagggtgaagctctttccccaccgga

SEQ ID NO: 4435 - DNA, 170 bp, Homo sapiens
tctcactaacagccatttccctaggtcatagaagagaacaaagtgcggcagtacgattccatccagaaactgctgaacgagaggagcctcttccggcaagccatcagcccctccgacagggtgaagctctttccccaccggaactcaagcaagtgcaagtctaagcccca

SEQ ID NO: 4436 - DNA, 170 bp, Homo sapiens
ggtcatagaagagaacaaagtgcggcagtacgattccatccagaaactgctgaacgagaggagcctcttccggcaagccatcagcccctccgacagggtgaagctctttccccaccggaactcaagcaagtgcaagtctaagccccagattgctgctctgaaagaggaga

SEQ ID NO: 4437 - DNA, 170 bp, Homo sapiens
gattccatccagaaactgctgaacgagaggagcctcttccggcaagccatcagcccctccgacagggtgaagctctttccccaccggaactcaagcaagtgcaagtctaagccccagattgctgctctgaaagaggagacagaagaagaggtgcaagatacaaggcttta

SEQ ID NO: 4438 - DNA, 170 bp, Homo sapiens
acgagaggagcctcttccggcaagccatcagcccctccgacagggtgaagctctttccccaccggaactcaagcaagtgcaagtctaagccccagattgctgctctgaaagaggagacagaagaagaggtgcaagatacaaggctttagagagcagcataaatgttgaca

SEQ ID NO: 4439 - DNA, 170 bp, Homo sapiens
tcagcccctccgacagggtgaagctctttccccaccggaactcaagcaagtgcaagtctaagccccagattgctgctctgaaagaggagacagaagaagaggtgcaagatacaaggctttagagagcagcataaatgttgacatgggacatttgctcatggaattggagc

SEQ ID NO: 4440 - DNA, 170 bp, Homo sapiens
ttgtatggtctccatgagattttgtctctataatacttgggttaatctccttggatatacttgtgtgaatcaaactatgttaagggaaataggacaactaaaatatttgcacatgcaacttattggtcccactttttattcttttgcagagaatgggatagagagctggc

SEQ ID NO: 4441 - DNA, 170 bp, Homo sapiens
gtctctataatacttgggttaatctccttggatatacttgtgtgaatcaaactatgttaagggaaataggacaactaaaatatttgcacatgcaacttattggtcccactttttattcttttgcagagaatgggatagagagctggcttcaaagaaaaatcctaaactca

SEQ ID NO: 4442 - DNA, 170 bp, Homo sapiens
ctccttggatatacttgtgtgaatcaaactatgttaagggaaataggacaactaaaatatttgcacatgcaacttattggtcccactttttattcttttgcagagaatgggatagagagctggcttcaaagaaaaatcctaaactcattaatgcccttcggcgatgtttt

SEQ ID NO: 4443 - DNA, 170 bp, Homo sapiens
tgttaagggaaataggacaactaaaatatttgcacatgcaacttattggtcccactttttattcttttgcagagaatgggatagagagctggcttcaaagaaaaatcctaaactcattaatgcccttcggcgatgttttttctggagatttatgttctatggaatctttt

SEQ ID NO: 4444 - DNA, 170 bp, Homo sapiens
aaatatttgcacatgcaacttattggtcccactttttattcttttgcagagaatgggatagagagctggcttcaaagaaaaatcctaaactcattaatgcccttcggcgatgttttttctggagatttatgttctatggaatctttttatatttaggggtaaggatctca

SEQ ID NO: 4445 - DNA, 170 bp, Homo sapiens
ggtcccactttttattcttttgcagagaatgggatagagagctggcttcaaagaaaaatcctaaactcattaatgcccttcggcgatgttttttctggagatttatgttctatggaatctttttatatttaggggtaaggatctcatttgtacattcattatgtatcaca

SEQ ID NO: 4446 - DNA, 170 bp, Homo sapiens
tgggatagagagctggcttcaaagaaaaatcctaaactcattaatgcccttcggcgatgttttttctggagatttatgttctatggaatctttttatatttaggggtaaggatctcatttgtacattcattatgtatcacataactatattcatttttgtgattatgaaa

SEQ ID NO: 4447 - DNA, 170 bp, Homo sapiens
caaagaaaaatcctaaactcattaatgcccttcggcgatgttttttctggagatttatgttctatggaatctttttatatttaggggtaaggatctcatttgtacattcattatgtatcacataactatattcatttttgtgattatgaaaagactacgaaatctggtga

SEQ ID NO: 4448 - DNA, 170 bp, Homo sapiens
tcggcgatgttttttctggagatttatgttctatggaatctttttatatttaggggtaaggatctcatttgtacattcattatgtatcacataactatattcatttttgtgattatgaaaagactacgaaatctggtgaataggtgtaaaaatataaaggatgaatccaa

SEQ ID NO: 4449 - DNA, 170 bp, Homo sapiens
tttatgttctatggaatctttttatatttaggggtaaggatctcatttgtacattcattatgtatcacataactatattcatttttgtgattatgaaaagactacgaaatctggtgaataggtgtaaaaatataaaggatgaatccaactccaaacactaagaaaccacc

SEQ ID NO: 4450 - DNA, 170 bp, Homo sapiens
ttcacatatggtatgaccctctatataaactcattttaagtctcctctaaagatgaaaagtcttgtgttgaaattctcagggtattttatgagaaataaatgaaatttaatttctctgtttttccccttttgtaggaagtcaccaaagcagtacagcctctcttactggg

SEQ ID NO: 4451 - DNA, 170 bp, Homo sapiens
taaactcattttaagtctcctctaaagatgaaaagtcttgtgttgaaattctcagggtattttatgagaaataaatgaaatttaatttctctgtttttccccttttgtaggaagtcaccaaagcagtacagcctctcttactgggaagaatcatagcttcctatgacccg

SEQ ID NO: 4452 - DNA, 170 bp, Homo sapiens
ttattgtgaggacactgctcctacacccagccatttttggccttcatcacattggaatgcagatgagaatagctatgtttagtttgatttataagaaggtaatacttccttgcacaggccccatggcacatatattctgtatcgtacatgttttaatgtcataaattagg

SEQ ID NO: 4453 - DNA, 170 bp, Homo sapiens
cacccagccatttttggccttcatcacattggaatgcagatgagaatagctatgtttagtttgatttataagaaggtaatacttccttgcacaggccccatggcacatatattctgtatcgtacatgttttaatgtcataaattaggtagtgagctggtacaagtaaggg

SEQ ID NO: 4454 - DNA, 170 bp, Homo sapiens
tggaatgcagatgagaatagctatgtttagtttgatttataagaaggtaatacttccttgcacaggccccatggcacatatattctgtatcgtacatgttttaatgtcataaattaggtagtgagctggtacaagtaagggataaatgctgaaattaatttaatatgcct

SEQ ID NO: 4455 - DNA, 170 bp, Homo sapiens
agctatgtttagtttgatttataagaaggtaatacttccttgcacaggccccatggcacatatattctgtatcgtacatgttttaatgtcataaattaggtagtgagctggtacaagtaagggataaatgctgaaattaatttaatatgcctattaaataaatggcagga

SEQ ID NO: 4456 - DNA, 170 bp, Homo sapiens
ctaaagatgaaaagtcttgtgttgaaattctcagggtattttatgagaaataaatgaaatttaatttctctgtttttccccttttgtaggaagtcaccaaagcagtacagcctctcttactgggaagaatcatagcttcctatgacccggataacaaggaggaacgctct

SEQ ID NO: 4457 - DNA, 170 bp, Homo sapiens
ttctcagggtattttatgagaaataaatgaaatttaatttctctgtttttccccttttgtaggaagtcaccaaagcagtacagcctctcttactgggaagaatcatagcttcctatgacccggataacaaggaggaacgctctatcgcgatttatctaggcataggctta

SEQ ID NO: 4458 - DNA, 170 bp, Homo sapiens
tgaaatttaatttctctgtttttccccttttgtaggaagtcaccaaagcagtacagcctctcttactgggaagaatcatagcttcctatgacccggataacaaggaggaacgctctatcgcgatttatctaggcataggcttatgccttctctttattgtgaggacactg

SEQ ID NO: 4459 - DNA, 170 bp, Homo sapiens
cccttttgtaggaagtcaccaaagcagtacagcctctcttactgggaagaatcatagcttcctatgacccggataacaaggaggaacgctctatcgcgatttatctaggcataggcttatgccttctctttattgtgaggacactgctcctacacccagccatttttggc

SEQ ID NO: 4460 - DNA, 170 bp, Homo sapiens
acagcctctcttactgggaagaatcatagcttcctatgacccggataacaaggaggaacgctctatcgcgatttatctaggcataggcttatgccttctctttattgtgaggacactgctcctacacccagccatttttggccttcatcacattggaatgcagatgagaa

SEQ ID NO: 4461 - DNA, 170 bp, Homo sapiens
agcttcctatgacccggataacaaggaggaacgctctatcgcgatttatctaggcataggcttatgccttctctttattgtgaggacactgctcctacacccagccatttttggccttcatcacattggaatgcagatgagaatagctatgtttagtttgatttataaga

SEQ ID NO: 4462 - DNA, 170 bp, Homo sapiens
aggaggaacgctctatcgcgatttatctaggcataggcttatgccttctctttattgtgaggacactgctcctacacccagccatttttggccttcatcacattggaatgcagatgagaatagctatgtttagtttgatttataagaaggtaatacttccttgcacaggc

SEQ ID NO: 4463 - DNA, 170 bp, Homo sapiens
tctaggcataggcttatgccttctctttattgtgaggacactgctcctacacccagccatttttggccttcatcacattggaatgcagatgagaatagctatgtttagtttgatttataagaaggtaatacttccttgcacaggccccatggcacatatattctgtatcg

SEQ ID NO: 4464 - DNA, 170 bp, Homo sapiens
tagtaagctagatgaatagaatataattttcattacctttacttaataatgaatgcataataactgaattagtcatattataattttacttataatatatttgtattttgtttgttgaaattatctaactttccatttttcttttagactttaaagctgtcaagccgtgt

SEQ ID NO: 4465 - DNA, 170 bp, Homo sapiens
tttcattacctttacttaataatgaatgcataataactgaattagtcatattataattttacttataatatatttgtattttgtttgttgaaattatctaactttccatttttcttttagactttaaagctgtcaagccgtgttctagataaaataagtattggacaact

SEQ ID NO: 4466 - DNA, 170 bp, Homo sapiens
gaatgcataataactgaattagtcatattataattttacttataatatatttgtattttgtttgttgaaattatctaactttccatttttcttttagactttaaagctgtcaagccgtgttctagataaaataagtattggacaacttgttagtctcctttccaacaacc

SEQ ID NO: 4467 - DNA, 170 bp, Homo sapiens
ttataattttacttataatatatttgtattttgtttgttgaaattatctaactttccatttttcttttagactttaaagctgtcaagccgtgttctagataaaataagtattggacaacttgttagtctcctttccaacaacctgaacaaatttgatgaagtatgtacct

SEQ ID NO: 4468 - DNA, 170 bp, Homo sapiens
tgtattttgtttgttgaaattatctaactttccatttttcttttagactttaaagctgtcaagccgtgttctagataaaataagtattggacaacttgttagtctcctttccaacaacctgaacaaatttgatgaagtatgtacctattgatttaatcttttaggcacta

SEQ ID NO: 4469 - DNA, 170 bp, Homo sapiens
catttttcttttagactttaaagctgtcaagccgtgttctagataaaataagtattggacaacttgttagtctcctttccaacaacctgaacaaatttgatgaagtatgtacctattgatttaatcttttaggcactattgttataaattatacaactggaaaggcggag

SEQ ID NO: 4470 - DNA, 170 bp, Homo sapiens
gctgtcaagccgtgttctagataaaataagtattggacaacttgttagtctcctttccaacaacctgaacaaatttgatgaagtatgtacctattgatttaatcttttaggcactattgttataaattatacaactggaaaggcggagttttcctgggtcagataatagt

SEQ ID NO: 4471 - DNA, 170 bp, Homo sapiens
aaaataagtattggacaacttgttagtctcctttccaacaacctgaacaaatttgatgaagtatgtacctattgatttaatcttttaggcactattgttataaattatacaactggaaaggcggagttttcctgggtcagataatagtaattagtggttaagtcttgctc

SEQ ID NO: 4472 - DNA, 170 bp, Homo sapiens
tctcctttccaacaacctgaacaaatttgatgaagtatgtacctattgatttaatcttttaggcactattgttataaattatacaactggaaaggcggagttttcctgggtcagataatagtaattagtggttaagtcttgctcagctctagcttccctattctggaaac

SEQ ID NO: 4473 - DNA, 170 bp, Homo sapiens
tacctagattttagtgtgctcagaaccacgaagtgtttgatcatataagctccttttacttgctttctttcatatatgattgttagtttctaggggtggaagatacaatgacacctgtttttgctgtgcttttattttccagggacttgcattggcacatttcgtgtgga

SEQ ID NO: 4474 - DNA, 170 bp, Homo sapiens
accacgaagtgtttgatcatataagctccttttacttgctttctttcatatatgattgttagtttctaggggtggaagatacaatgacacctgtttttgctgtgcttttattttccagggacttgcattggcacatttcgtgtggatcgctcctttgcaagtggcactcc

SEQ ID NO: 4475 - DNA, 170 bp, Homo sapiens
ctgatagtccttgccctttttcaggctgggctagggagaatgatgatgaagtacaggtagcaacctattttcataacttgaaagttttaaaaattatgttttcaaaaagcccactttagtaaaaccaggactgctctatgcatagaacagtgatcttcagtgtcattaaa

SEQ ID NO: 4476 - DNA, 170 bp, Homo sapiens
gggctagggagaatgatgatgaagtacaggtagcaacctattttcataacttgaaagttttaaaaattatgttttcaaaaagcccactttagtaaaaccaggactgctctatgcatagaacagtgatcttcagtgtcattaaattttttttttttttttttttttgagac

SEQ ID NO: 4477 - DNA, 170 bp, Homo sapiens
gctccttttacttgctttctttcatatatgattgttagtttctaggggtggaagatacaatgacacctgtttttgctgtgcttttattttccagggacttgcattggcacatttcgtgtggatcgctcctttgcaagtggcactcctcatggggctaatctgggagttgt

SEQ ID NO: 4478 - DNA, 170 bp, Homo sapiens
tgattgttagtttctaggggtggaagatacaatgacacctgtttttgctgtgcttttattttccagggacttgcattggcacatttcgtgtggatcgctcctttgcaagtggcactcctcatggggctaatctgggagttgttacaggcgtctgccttctgtggacttgg

SEQ ID NO: 4479 - DNA, 170 bp, Homo sapiens
ggaagatacaatgacacctgtttttgctgtgcttttattttccagggacttgcattggcacatttcgtgtggatcgctcctttgcaagtggcactcctcatggggctaatctgggagttgttacaggcgtctgccttctgtggacttggtttcctgatagtccttgccct

SEQ ID NO: 4480 - DNA, 170 bp, Homo sapiens
ctgtgcttttattttccagggacttgcattggcacatttcgtgtggatcgctcctttgcaagtggcactcctcatggggctaatctgggagttgttacaggcgtctgccttctgtggacttggtttcctgatagtccttgccctttttcaggctgggctagggagaatga

SEQ ID NO: 4481 - DNA, 170 bp, Homo sapiens
acatttcgtgtggatcgctcctttgcaagtggcactcctcatggggctaatctgggagttgttacaggcgtctgccttctgtggacttggtttcctgatagtccttgccctttttcaggctgggctagggagaatgatgatgaagtacaggtagcaacctattttcataa

SEQ ID NO: 4482 - DNA, 170 bp, Homo sapiens
cctttgcaagtggcactcctcatggggctaatctgggagttgttacaggcgtctgccttctgtggacttggtttcctgatagtccttgccctttttcaggctgggctagggagaatgatgatgaagtacaggtagcaacctattttcataacttgaaagttttaaaaatt

SEQ ID NO: 4483 - DNA, 170 bp, Homo sapiens
ggctaatctgggagttgttacaggcgtctgccttctgtggacttggtttcctgatagtccttgccctttttcaggctgggctagggagaatgatgatgaagtacaggtagcaacctattttcataacttgaaagttttaaaaattatgttttcaaaaagcccactttagt

SEQ ID NO: 4484 - DNA, 170 bp, Homo sapiens
tctgccttctgtggacttggtttcctgatagtccttgccctttttcaggctgggctagggagaatgatgatgaagtacaggtagcaacctattttcataacttgaaagttttaaaaattatgttttcaaaaagcccactttagtaaaaccaggactgctctatgcataga

SEQ ID NO: 4485 - DNA, 170 bp, Homo sapiens
tgttaccatctatttgataataaaataatgcccatctgttgaataaaagaaatatgacttaaaaccttgagcagttcttaatagataatttgacttgtttttactattagattgattgattgattgattgattgatttacagagatcagagagctgggaagatcagtgaa

SEQ ID NO: 4486 - DNA, 170 bp, Homo sapiens
gcccatctgttgaataaaagaaatatgacttaaaaccttgagcagttcttaatagataatttgacttgtttttactattagattgattgattgattgattgattgatttacagagatcagagagctgggaagatcagtgaaagacttgtgattacctcagaaatgattga

SEQ ID NO: 4487 - DNA, 170 bp, Homo sapiens
tgacttaaaaccttgagcagttcttaatagataatttgacttgtttttactattagattgattgattgattgattgattgatttacagagatcagagagctgggaagatcagtgaaagacttgtgattacctcagaaatgattgaaaatatccaatctgttaaggcatac

SEQ ID NO: 4488 - DNA, 170 bp, Homo sapiens
tcttaatagataatttgacttgtttttactattagattgattgattgattgattgattgatttacagagatcagagagctgggaagatcagtgaaagacttgtgattacctcagaaatgattgaaaatatccaatctgttaaggcatactgctgggaagaagcaatggaa

SEQ ID NO: 4489 - DNA, 170 bp, Homo sapiens
actattagattgattgattgattgattgattgatttacagagatcagagagctgggaagatcagtgaaagacttgtgattacctcagaaatgattgaaaatatccaatctgttaaggcatactgctgggaagaagcaatggaaaaaatgattgaaaacttaagacagtaa

SEQ ID NO: 4490 - DNA, 170 bp, Homo sapiens
ttgatttacagagatcagagagctgggaagatcagtgaaagacttgtgattacctcagaaatgattgaaaatatccaatctgttaaggcatactgctgggaagaagcaatggaaaaaatgattgaaaacttaagacagtaagttgttccaataatttcaatattgttagt

SEQ ID NO: 4491 - DNA, 170 bp, Homo sapiens
tgggaagatcagtgaaagacttgtgattacctcagaaatgattgaaaatatccaatctgttaaggcatactgctgggaagaagcaatggaaaaaatgattgaaaacttaagacagtaagttgttccaataatttcaatattgttagtaattctgtccttaattttttaaa

SEQ ID NO: 4492 - DNA, 170 bp, Homo sapiens
ttacctcagaaatgattgaaaatatccaatctgttaaggcatactgctgggaagaagcaatggaaaaaatgattgaaaacttaagacagtaagttgttccaataatttcaatattgttagtaattctgtccttaattttttaaaaatatgtttatcatggtagacttcca

SEQ ID NO: 4493 - DNA, 170 bp, Homo sapiens
tccaatctgttaaggcatactgctgggaagaagcaatggaaaaaatgattgaaaacttaagacagtaagttgttccaataatttcaatattgttagtaattctgtccttaattttttaaaaatatgtttatcatggtagacttccacctcatatttgatgtttgtgacaa

SEQ ID NO: 4494 - DNA, 170 bp, Homo sapiens
gggaagaagcaatggaaaaaatgattgaaaacttaagacagtaagttgttccaataatttcaatattgttagtaattctgtccttaattttttaaaaatatgtttatcatggtagacttccacctcatatttgatgtttgtgacaatcaaatgattgcatttaagttctg

SEQ ID NO: 4495 - DNA, 170 bp, Homo sapiens
aggtcatatgatgtggagccaggttaaaaatataggcagaaagactctagagaccatgctcagatcttccattccaagatccctgatatttgaaaaataaaataacatcctgaattttattgttattgttttttatagaacagaactgaaactgactcggaaggcagcct

SEQ ID NO: 4496 - DNA, 170 bp, Homo sapiens
aaaaatataggcagaaagactctagagaccatgctcagatcttccattccaagatccctgatatttgaaaaataaaataacatcctgaattttattgttattgttttttatagaacagaactgaaactgactcggaaggcagcctatgtgagatacttcaatagctcagc

SEQ ID NO: 4497 - DNA, 170 bp, Homo sapiens
aggaatcatcctccggaaaatattcaccaccatctcattctgcattgttctgcgcatggcggtcactcggcaatttccctgggctgtacaaacatggtatgactctcttggagcaataaacaaaatacaggtaatgtaccataatgctgcattatatactatgatttaaa

SEQ ID NO: 4498 - DNA, 170 bp, Homo sapiens
tcaccaccatctcattctgcattgttctgcgcatggcggtcactcggcaatttccctgggctgtacaaacatggtatgactctcttggagcaataaacaaaatacaggtaatgtaccataatgctgcattatatactatgatttaaataatcagtcaatagatcagttct

SEQ ID NO: 4499 - DNA, 170 bp, Homo sapiens
cgcatggcggtcactcggcaatttccctgggctgtacaaacatggtatgactctcttggagcaataaacaaaatacaggtaatgtaccataatgctgcattatatactatgatttaaataatcagtcaatagatcagttctaatgaactttgcaaaaatgtgcgaaaaga

SEQ ID NO: 4500 - DNA, 170 bp, Homo sapiens
tccctgggctgtacaaacatggtatgactctcttggagcaataaacaaaatacaggtaatgtaccataatgctgcattatatactatgatttaaataatcagtcaatagatcagttctaatgaactttgcaaaaatgtgcgaaaagatagaaaaagaaatttccttcact

SEQ ID NO: 4501 - DNA, 170 bp, Homo sapiens
tgactctcttggagcaataaacaaaatacaggtaatgtaccataatgctgcattatatactatgatttaaataatcagtcaatagatcagttctaatgaactttgcaaaaatgtgcgaaaagatagaaaaagaaatttccttcactaggaagttataaaagttgccagct

SEQ ID NO: 4502 - DNA, 170 bp, Homo sapiens
accatgctcagatcttccattccaagatccctgatatttgaaaaataaaataacatcctgaattttattgttattgttttttatagaacagaactgaaactgactcggaaggcagcctatgtgagatacttcaatagctcagccttcttcttctcagggttctttgtggt

SEQ ID NO: 4503 - DNA, 170 bp, Homo sapiens
agatccctgatatttgaaaaataaaataacatcctgaattttattgttattgttttttatagaacagaactgaaactgactcggaaggcagcctatgtgagatacttcaatagctcagccttcttcttctcagggttctttgtggtgtttttatctgtgcttccctatgc

SEQ ID NO: 4504 - DNA, 170 bp, Homo sapiens
taacatcctgaattttattgttattgttttttatagaacagaactgaaactgactcggaaggcagcctatgtgagatacttcaatagctcagccttcttcttctcagggttctttgtggtgtttttatctgtgcttccctatgcactaatcaaaggaatcatcctccgga

SEQ ID NO: 4505 - DNA, 170 bp, Homo sapiens
ttttttatagaacagaactgaaactgactcggaaggcagcctatgtgagatacttcaatagctcagccttcttcttctcagggttctttgtggtgtttttatctgtgcttccctatgcactaatcaaaggaatcatcctccggaaaatattcaccaccatctcattctgc

SEQ ID NO: 4506 - DNA, 170 bp, Homo sapiens
actgactcggaaggcagcctatgtgagatacttcaatagctcagccttcttcttctcagggttctttgtggtgtttttatctgtgcttccctatgcactaatcaaaggaatcatcctccggaaaatattcaccaccatctcattctgcattgttctgcgcatggcggtca

SEQ ID NO: 4507 - DNA, 170 bp, Homo sapiens
aatagctcagccttcttcttctcagggttctttgtggtgtttttatctgtgcttccctatgcactaatcaaaggaatcatcctccggaaaatattcaccaccatctcattctgcattgttctgcgcatggcggtcactcggcaatttccctgggctgtacaaacatggta

SEQ ID NO: 4508 - DNA, 170 bp, Homo sapiens
tctcagggttctttgtggtgtttttatctgtgcttccctatgcactaatcaaaggaatcatcctccggaaaatattcaccaccatctcattctgcattgttctgcgcatggcggtcactcggcaatttccctgggctgtacaaacatggtatgactctcttggagcaata

SEQ ID NO: 4509 - DNA, 170 bp, Homo sapiens
tgcttccctatgcactaatcaaaggaatcatcctccggaaaatattcaccaccatctcattctgcattgttctgcgcatggcggtcactcggcaatttccctgggctgtacaaacatggtatgactctcttggagcaataaacaaaatacaggtaatgtaccataatgct

SEQ ID NO: 4510 - DNA, 170 bp, Homo sapiens
ctaataaaattattttattaagaaataattactatttcattattaaaattcatatataagatgtagcacaatgagagtataaagtagatgtaataatgcattaatgctattctgattctataatatgtttttgctctcttttataaataggatttcttacaaaagcaaga

SEQ ID NO: 4511 - DNA, 170 bp, Homo sapiens
attactatttcattattaaaattcatatataagatgtagcacaatgagagtataaagtagatgtaataatgcattaatgctattctgattctataatatgtttttgctctcttttataaataggatttcttacaaaagcaagaatataagacattggaatataacttaac

SEQ ID NO: 4512 - DNA, 170 bp, Homo sapiens
tataagatgtagcacaatgagagtataaagtagatgtaataatgcattaatgctattctgattctataatatgtttttgctctcttttataaataggatttcttacaaaagcaagaatataagacattggaatataacttaacgactacagaagtagtgatggagaatgt

SEQ ID NO: 4513 - DNA, 170 bp, Homo sapiens
agtataaagtagatgtaataatgcattaatgctattctgattctataatatgtttttgctctcttttataaataggatttcttacaaaagcaagaatataagacattggaatataacttaacgactacagaagtagtgatggagaatgtaacagccttctgggaggaggt

SEQ ID NO: 4514 - DNA, 170 bp, Homo sapiens
tgctattctgattctataatatgtttttgctctcttttataaataggatttcttacaaaagcaagaatataagacattggaatataacttaacgactacagaagtagtgatggagaatgtaacagccttctgggaggaggtcagaatttttaaaaaattgtttgctctaa

SEQ ID NO: 4515 - DNA, 170 bp, Homo sapiens
tttgctctcttttataaataggatttcttacaaaagcaagaatataagacattggaatataacttaacgactacagaagtagtgatggagaatgtaacagccttctgggaggaggtcagaatttttaaaaaattgtttgctctaaacacctaactgttttcttctttgtg

SEQ ID NO: 4516 - DNA, 170 bp, Homo sapiens
caaaagcaagaatataagacattggaatataacttaacgactacagaagtagtgatggagaatgtaacagccttctgggaggaggtcagaatttttaaaaaattgtttgctctaaacacctaactgttttcttctttgtgaatatggatttcatcctaatggcgaataaa

SEQ ID NO: 4517 - DNA, 170 bp, Homo sapiens
tggaatataacttaacgactacagaagtagtgatggagaatgtaacagccttctgggaggaggtcagaatttttaaaaaattgtttgctctaaacacctaactgttttcttctttgtgaatatggatttcatcctaatggcgaataaaattagaatgatgatataactgg

SEQ ID NO: 4518 - DNA, 170 bp, Homo sapiens
cagaagtagtgatggagaatgtaacagccttctgggaggaggtcagaatttttaaaaaattgtttgctctaaacacctaactgttttcttctttgtgaatatggatttcatcctaatggcgaataaaattagaatgatgatataactggtagaactggaaggaggatcac

SEQ ID NO: 4519 - DNA, 170 bp, Homo sapiens
gagtaaactccatgcaggccctgcagcagcaaccaggtaggggtgcctgcaaccccagggccccagagggtgtgttacaatgctctcgtagctctgccatctgtggacagcagtgtgttgtcagctcagtgggccctttgcttcatcatgtagggtggctgccctctgcc

SEQ ID NO: 4520 - DNA, 170 bp, Homo sapiens
gctggctgctttagtgctgtgaggagtaaactccatgcaggccctgcagcagcaaccaggtaggggtgcctgcaaccccagggccccagagggtgtgttacaatgctctcgtagctctgccatctgtggacagcagtgtgttgtcagctcagtgggccctttgcttcatc

SEQ ID NO: 4521 - DNA, 170 bp, Homo sapiens
agtgaacgagtgcaggaaccagctggctgctttagtgctgtgaggagtaaactccatgcaggccctgcagcagcaaccaggtaggggtgcctgcaaccccagggccccagagggtgtgttacaatgctctcgtagctctgccatctgtggacagcagtgtgttgtcagct

SEQ ID NO: 4522 - DNA, 170 bp, Homo sapiens
acctcttgcaggagggagcacacgagtgaacgagtgcaggaaccagctggctgctttagtgctgtgaggagtaaactccatgcaggccctgcagcagcaaccaggtaggggtgcctgcaaccccagggccccagagggtgtgttacaatgctctcgtagctctgccatct

SEQ ID NO: 4523 - DNA, 170 bp, Homo sapiens
accccatttactcagcctgccctgctcaacctcttgcaggagggagcacacgagtgaacgagtgcaggaaccagctggctgctttagtgctgtgaggagtaaactccatgcaggccctgcagcagcaaccaggtaggggtgcctgcaaccccagggccccagagggtgtg

SEQ ID NO: 4524 - DNA, 170 bp, Homo sapiens
ccttcatgggactcccaacaggggtaccccatttactcagcctgccctgctcaacctcttgcaggagggagcacacgagtgaacgagtgcaggaaccagctggctgctttagtgctgtgaggagtaaactccatgcaggccctgcagcagcaaccaggtaggggtgcctg

SEQ ID NO: 4525 - DNA, 170 bp, Homo sapiens
ccttttgagcttcatttcaggtaagtacaaaattctacctctgaagacaaatgtgcttttcaatatgtcaaaaagaccgtctacctaaatataaagttataatcttaacatatatacatggatgcacactgtagtattatacataataacaaaaagtgtggaaataccac

SEQ ID NO: 4526 - DNA, 170 bp, Homo sapiens
ctgcatggtcccctagggctgtaccttttgagcttcatttcaggtaagtacaaaattctacctctgaagacaaatgtgcttttcaatatgtcaaaaagaccgtctacctaaatataaagttataatcttaacatatatacatggatgcacactgtagtattatacataat

SEQ ID NO: 4527 - DNA, 170 bp, Homo sapiens
aaattaaaaaagagagatttgatttttaaaattatacttgcagactactgctaatgaaacttcttctaaccctagttttgtcttatcttcagtttttccagatttgctcaaagcaatcccagtgagcatccacgtcaatgtcattctcttctctgccatccttattgtgt

SEQ ID NO: 4528 - DNA, 170 bp, Homo sapiens
tcatcagaaggattttagtgatgtttgaaattaaaaaagagagatttgatttttaaaattatacttgcagactactgctaatgaaacttcttctaaccctagttttgtcttatcttcagtttttccagatttgctcaaagcaatcccagtgagcatccacgtcaatgtca

SEQ ID NO: 4529 - DNA, 170 bp, Homo sapiens
aagttagtaagtgagaatgtattcatcagaaggattttagtgatgtttgaaattaaaaaagagagatttgatttttaaaattatacttgcagactactgctaatgaaacttcttctaaccctagttttgtcttatcttcagtttttccagatttgctcaaagcaatccca

SEQ ID NO: 4530 - DNA, 170 bp, Homo sapiens
tgcttttggaaaaccttttgaaactctgcatggtcccctagggctgtaccttttgagcttcatttcaggtaagtacaaaattctacctctgaagacaaatgtgcttttcaatatgtcaaaaagaccgtctacctaaatataaagttataatcttaacatatatacatgga

SEQ ID NO: 4531 - DNA, 170 bp, Homo sapiens
tggggacagccttcttcatgtacaatgcttttggaaaaccttttgaaactctgcatggtcccctagggctgtaccttttgagcttcatttcaggtaagtacaaaattctacctctgaagacaaatgtgcttttcaatatgtcaaaaagaccgtctacctaaatataaagt

SEQ ID NO: 4532 - DNA, 170 bp, Homo sapiens
ctgccatccttattgtgttaaccatggtggggacagccttcttcatgtacaatgcttttggaaaaccttttgaaactctgcatggtcccctagggctgtaccttttgagcttcatttcaggtaagtacaaaattctacctctgaagacaaatgtgcttttcaatatgtca

SEQ ID NO: 4533 - DNA, 170 bp, Homo sapiens
tccacgtcaatgtcattctcttctctgccatccttattgtgttaaccatggtggggacagccttcttcatgtacaatgcttttggaaaaccttttgaaactctgcatggtcccctagggctgtaccttttgagcttcatttcaggtaagtacaaaattctacctctgaag

SEQ ID NO: 4534 - DNA, 170 bp, Homo sapiens
tgctcaaagcaatcccagtgagcatccacgtcaatgtcattctcttctctgccatccttattgtgttaaccatggtggggacagccttcttcatgtacaatgcttttggaaaaccttttgaaactctgcatggtcccctagggctgtaccttttgagcttcatttcaggt

SEQ ID NO: 4535 - DNA, 170 bp, Homo sapiens
agttttgtcttatcttcagtttttccagatttgctcaaagcaatcccagtgagcatccacgtcaatgtcattctcttctctgccatccttattgtgttaaccatggtggggacagccttcttcatgtacaatgcttttggaaaaccttttgaaactctgcatggtcccct

SEQ ID NO: 4536 - DNA, 170 bp, Homo sapiens
gctaatgaaacttcttctaaccctagttttgtcttatcttcagtttttccagatttgctcaaagcaatcccagtgagcatccacgtcaatgtcattctcttctctgccatccttattgtgttaaccatggtggggacagccttcttcatgtacaatgcttttggaaaacc

SEQ ID NO: 4537 - DNA, 170 bp, Homo sapiens
tttttaaaattatacttgcagactactgctaatgaaacttcttctaaccctagttttgtcttatcttcagtttttccagatttgctcaaagcaatcccagtgagcatccacgtcaatgtcattctcttctctgccatccttattgtgttaaccatggtggggacagcctt

SEQ ID NO: 4538 - DNA, 170 bp, Homo sapiens
aatataccacctcattctgggtcattttcttttgcttttttgttcattttctgaatgggctcctaatacgacttgctggatttcagttcccttttgcaaaatctaaagacgcagaaacaactaatgtagctgcagatctaatgtactgaaaggcaaacctttctataatt

SEQ ID NO: 4539 - DNA, 170 bp, Homo sapiens
tgtctacaaaacgcaaagtgaaaaatataccacctcattctgggtcattttcttttgcttttttgttcattttctgaatgggctcctaatacgacttgctggatttcagttcccttttgcaaaatctaaagacgcagaaacaactaatgtagctgcagatctaatgtact

SEQ ID NO: 4540 - DNA, 170 bp, Homo sapiens
tgcaataattttttgtgtggataatgtcaatggggatgatggtaagagaattccttggtttacacattgaccctcttccctgtcccttacaatcaggaaatatttgtcccaacaccttgtttcttctgttgcaggctcctgtggctgtcttgtcatgatattgtttgcct

SEQ ID NO: 4541 - DNA, 170 bp, Homo sapiens
aaattgcaaattataaagaagggacttatgtctacaaaacgcaaagtgaaaaatataccacctcattctgggtcattttcttttgcttttttgttcattttctgaatgggctcctaatacgacttgctggatttcagttcccttttgcaaaatctaaagacgcagaaaca

SEQ ID NO: 4542 - DNA, 170 bp, Homo sapiens
agtgaaaatccatcacctctcagaaaaaattgcaaattataaagaagggacttatgtctacaaaacgcaaagtgaaaaatataccacctcattctgggtcattttcttttgcttttttgttcattttctgaatgggctcctaatacgacttgctggatttcagttccctt

SEQ ID NO: 4543 - DNA, 170 bp, Homo sapiens
gtcatgatattgtttgcctctgaagtgaaaatccatcacctctcagaaaaaattgcaaattataaagaagggacttatgtctacaaaacgcaaagtgaaaaatataccacctcattctgggtcattttcttttgcttttttgttcattttctgaatgggctcctaatacg

SEQ ID NO: 4544 - DNA, 170 bp, Homo sapiens
gcaggctcctgtggctgtcttgtcatgatattgtttgcctctgaagtgaaaatccatcacctctcagaaaaaattgcaaattataaagaagggacttatgtctacaaaacgcaaagtgaaaaatataccacctcattctgggtcattttcttttgcttttttgttcattt

SEQ ID NO: 4545 - DNA, 170 bp, Homo sapiens
ttgtcccaacaccttgtttcttctgttgcaggctcctgtggctgtcttgtcatgatattgtttgcctctgaagtgaaaatccatcacctctcagaaaaaattgcaaattataaagaagggacttatgtctacaaaacgcaaagtgaaaaatataccacctcattctgggt

SEQ ID NO: 4546 - DNA, 170 bp, Homo sapiens
ccctgtcccttacaatcaggaaatatttgtcccaacaccttgtttcttctgttgcaggctcctgtggctgtcttgtcatgatattgtttgcctctgaagtgaaaatccatcacctctcagaaaaaattgcaaattataaagaagggacttatgtctacaaaacgcaaagt

SEQ ID NO: 4547 - DNA, 170 bp, Homo sapiens
ccttggtttacacattgaccctcttccctgtcccttacaatcaggaaatatttgtcccaacaccttgtttcttctgttgcaggctcctgtggctgtcttgtcatgatattgtttgcctctgaagtgaaaatccatcacctctcagaaaaaattgcaaattataaagaagg

SEQ ID NO: 4548 - DNA, 170 bp, Homo sapiens
tcaatggggatgatggtaagagaattccttggtttacacattgaccctcttccctgtcccttacaatcaggaaatatttgtcccaacaccttgtttcttctgttgcaggctcctgtggctgtcttgtcatgatattgtttgcctctgaagtgaaaatccatcacctctca

SEQ ID NO: 4549 - DNA, 170 bp, Homo sapiens
tgactaaaggccacagctgagcctggaactgacccttccttcatcctcaacctgctgtcctccagaaagcaccaaggaaaaagcagagaatgacagcaaacagatcactaggcctctgaccacaggtgctgagtactcagcagccctcatataataggtttgaaagtact

SEQ ID NO: 4550 - DNA, 170 bp, Homo sapiens
tgaattacccatcaaattgatctgcagctgactaaaggccacagctgagcctggaactgacccttccttcatcctcaacctgctgtcctccagaaagcaccaaggaaaaagcagagaatgacagcaaacagatcactaggcctctgaccacaggtgctgagtactcagca

SEQ ID NO: 4551 - DNA, 170 bp, Homo sapiens
cccaggtcaactttttttttcccctgaattacccatcaaattgatctgcagctgactaaaggccacagctgagcctggaactgacccttccttcatcctcaacctgctgtcctccagaaagcaccaaggaaaaagcagagaatgacagcaaacagatcactaggcctctg

SEQ ID NO: 4552 - DNA, 170 bp, Homo sapiens
tctggctgtcaccaagcatgacccaggtcaactttttttttcccctgaattacccatcaaattgatctgcagctgactaaaggccacagctgagcctggaactgacccttccttcatcctcaacctgctgtcctccagaaagcaccaaggaaaaagcagagaatgacagc

SEQ ID NO: 4553 - DNA, 170 bp, Homo sapiens
ggtatcactgtatcatcttggtcttgttctggctgtcaccaagcatgacccaggtcaactttttttttcccctgaattacccatcaaattgatctgcagctgactaaaggccacagctgagcctggaactgacccttccttcatcctcaacctgctgtcctccagaaagc

SEQ ID NO: 4554 - DNA, 170 bp, Homo sapiens
tgaaaattatattaaatctgggattatgacggtatcactgtatcatcttggtcttgttctggctgtcaccaagcatgacccaggtcaactttttttttcccctgaattacccatcaaattgatctgcagctgactaaaggccacagctgagcctggaactgacccttcct

SEQ ID NO: 4555 - DNA, 170 bp, Homo sapiens
tggccagaccaagggaagatccagatccagaacctgagcgtgcgctacgacagctccctgaagccggtgctgaagcacgtcaatgccctcatcgcccctggacagaaggtcagagcacgggcccaacccaatgctgcaggacaggcgtgagcaggggatggggcatgcac

SEQ ID NO: 4556 - DNA, 170 bp, Homo sapiens
gcaccatcgctgatcccaaagaactggccagaccaagggaagatccagatccagaacctgagcgtgcgctacgacagctccctgaagccggtgctgaagcacgtcaatgccctcatcgcccctggacagaaggtcagagcacgggcccaacccaatgctgcaggacaggc

SEQ ID NO: 4557 - DNA, 170 bp, Homo sapiens
tggctgagcccagcccggcccccagcaccatcgctgatcccaaagaactggccagaccaagggaagatccagatccagaacctgagcgtgcgctacgacagctccctgaagccggtgctgaagcacgtcaatgccctcatcgcccctggacagaaggtcagagcacgggc

SEQ ID NO: 4558 - DNA, 170 bp, Homo sapiens; identical to SEQ ID NO: 3515

SEQ ID NO: 4559 - DNA, 170 bp, Homo sapiens
ctggggatggggtggcactttcggatactagctgtggcccatgcctggtggctgagcccagcccggcccccagcaccatcgctgatcccaaagaactggccagaccaagggaagatccagatccagaacctgagcgtgcgctacgacagctccctgaagccggtgctgaa

SEQ ID NO: 4560 - DNA, 170 bp, Homo sapiens; identical to SEQ ID NO: 3517

SEQ ID NO: 4561 - DNA, 170 bp, Homo sapiens
gtggggaagagtccaaggaggagtgtgtctgggttgggggccacaagggagcctggggatggggtggcactttcggatactagctgtggcccatgcctggtggctgagcccagcccggcccccagcaccatcgctgatcccaaagaactggccagaccaagggaagatcc

SEQ ID NO: 4562 - DNA, 170 bp, Homo sapiens
cctgggtgagaggctcagggagaggggtggggaagagtccaaggaggagtgtgtctgggttgggggccacaagggagcctggggatggggtggcactttcggatactagctgtggcccatgcctggtggctgagcccagcccggcccccagcaccatcgctgatcccaaa

SEQ ID NO: 4563 - DNA, 170 bp, Homo sapiens
aaccgaggcagagagctacgaggggctcctgggtgagaggctcagggagaggggtggggaagagtccaaggaggagtgtgtctgggttgggggccacaagggagcctggggatggggtggcactttcggatactagctgtggcccatgcctggtggctgagcccagcccg

SEQ ID NO: 4564 - DNA, 170 bp, Homo sapiens
gcgcatccatgggctcctgaaaaccgaggcagagagctacgaggggctcctgggtgagaggctcagggagaggggtggggaagagtccaaggaggagtgtgtctgggttgggggccacaagggagcctggggatggggtggcactttcggatactagctgtggcccatgc

SEQ ID NO: 4565 - DNA, 170 bp, Homo sapiens
tgggccacgtcagcttcttcaaagaggccgacttctcgccctccgtggcctttgcctccctctccctcttccatatcttggtcacaccgctgttcctgctgtccagtgtggtccgatctaccgtcaaagctctagtgaggtgaggggagggtccgggcgagggcactggg

SEQ ID NO: 4566 - DNA, 170 bp, Homo sapiens
tgcctctgtccacagactttcgtgggccacgtcagcttcttcaaagaggccgacttctcgccctccgtggcctttgcctccctctccctcttccatatcttggtcacaccgctgttcctgctgtccagtgtggtccgatctaccgtcaaagctctagtgaggtgagggga

SEQ ID NO: 4567 - DNA, 170 bp, Homo sapiens
ctgggccaccctggcctcacttgtgcctctgtccacagactttcgtgggccacgtcagcttcttcaaagaggccgacttctcgccctccgtggcctttgcctccctctccctcttccatatcttggtcacaccgctgttcctgctgtccagtgtggtccgatctaccgtc

SEQ ID NO: 4568 - DNA, 170 bp, Homo sapiens
gagcgtttccagtgtgggagggacccacaccctgggccaccctggcctcacttgtgcctctgtccacagactttcgtgggccacgtcagcttcttcaaagaggccgacttctcgccctccgtggcctttgcctccctctccctcttccatatcttggtcacaccgctgtt

SEQ ID NO: 4569 - DNA, 170 bp, Homo sapiens
gccctctcatttcccttccagtgctgagcgtttccagtgtgggagggacccacaccctgggccaccctggcctcacttgtgcctctgtccacagactttcgtgggccacgtcagcttcttcaaagaggccgacttctcgccctccgtggcctttgcctccctctccctct

SEQ ID NO: 4570 - DNA, 170 bp, Homo sapiens
ctcttaggagcctgctccctgacagccctctcatttcccttccagtgctgagcgtttccagtgtgggagggacccacaccctgggccaccctggcctcacttgtgcctctgtccacagactttcgtgggccacgtcagcttcttcaaagaggccgacttctcgccctccg

SEQ ID NO: 4571 - DNA, 170 bp, Homo sapiens
gatgaaggtgtctccaactaaaagatcctcttaggagcctgctccctgacagccctctcatttcccttccagtgctgagcgtttccagtgtgggagggacccacaccctgggccaccctggcctcacttgtgcctctgtccacagactttcgtgggccacgtcagcttct

SEQ ID NO: 4572 - DNA, 170 bp, Homo sapiens
tccatgagatgactgtggggatgatgaaggtgtctccaactaaaagatcctcttaggagcctgctccctgacagccctctcatttcccttccagtgctgagcgtttccagtgtgggagggacccacaccctgggccaccctggcctcacttgtgcctctgtccacagact

SEQ ID NO: 4573 - DNA, 170 bp, Homo sapiens
tgaagtcctgaacttgttggggacgtttccatgagatgactgtggggatgatgaaggtgtctccaactaaaagatcctcttaggagcctgctccctgacagccctctcatttcccttccagtgctgagcgtttccagtgtgggagggacccacaccctgggccaccctgg

SEQ ID NO: 4574 - DNA, 170 bp, Homo sapiens
agcagcccctgctctccagcttgaagtcctgaacttgttggggacgtttccatgagatgactgtggggatgatgaaggtgtctccaactaaaagatcctcttaggagcctgctccctgacagccctctcatttcccttccagtgctgagcgtttccagtgtgggagggac

SEQ ID NO: 4575 - DNA, 170 bp, Homo sapiens
ggatccattatgtagctcttgcatactgtcttcaaaaataagttacactataaaggttgttttagacttttaaagttttgccattggtttttaaaaaaatttttaaattggctttaaaaatttcttaattgtgtgctgaatacaattttctttattacagaagtaccaac

SEQ ID NO: 4576 - DNA, 170 bp, Homo sapiens
tgtcttcaaaaataagttacactataaaggttgttttagacttttaaagttttgccattggtttttaaaaaaatttttaaattggctttaaaaatttcttaattgtgtgctgaatacaattttctttattacagaagtaccaacaattacatgtataaacagagaatcct

SEQ ID NO: 4577 - DNA, 170 bp, Homo sapiens
aaaggttgttttagacttttaaagttttgccattggtttttaaaaaaatttttaaattggctttaaaaatttcttaattgtgtgctgaatacaattttctttattacagaagtaccaacaattacatgtataaacagagaatcctatgtacttgagatataagtaaggtt

SEQ ID NO: 4578 - DNA, 170 bp, Homo sapiens
agttttgccattggtttttaaaaaaatttttaaattggctttaaaaatttcttaattgtgtgctgaatacaattttctttattacagaagtaccaacaattacatgtataaacagagaatcctatgtacttgagatataagtaaggttactatcaatcacacctgaaaaa

SEQ ID NO: 4579 - DNA, 170 bp, Homo sapiens
ttttaaattggctttaaaaatttcttaattgtgtgctgaatacaattttctttattacagaagtaccaacaattacatgtataaacagagaatcctatgtacttgagatataagtaaggttactatcaatcacacctgaaaaatttaaatgttatgaagaaattatctca

SEQ ID NO: 4580 - DNA, 170 bp, Homo sapiens
ttgtgtgctgaatacaattttctttattacagaagtaccaacaattacatgtataaacagagaatcctatgtacttgagatataagtaaggttactatcaatcacacctgaaaaatttaaatgttatgaagaaattatctcatttctattaatatgggaactgtgtcttc

SEQ ID NO: 4581 - DNA, 170 bp, Homo sapiens
ttattacagaagtaccaacaattacatgtataaacagagaatcctatgtacttgagatataagtaaggttactatcaatcacacctgaaaaatttaaatgttatgaagaaattatctcatttctattaatatgggaactgtgtcttcatctttattactgttctaaggtc

SEQ ID NO: 4582 - DNA, 170 bp, Homo sapiens
catgtataaacagagaatcctatgtacttgagatataagtaaggttactatcaatcacacctgaaaaatttaaatgttatgaagaaattatctcatttctattaatatgggaactgtgtcttcatctttattactgttctaaggtcaactcaatgtagattttacttgct

SEQ ID NO: 4583 - DNA, 170 bp, Homo sapiens
ttgagatataagtaaggttactatcaatcacacctgaaaaatttaaatgttatgaagaaattatctcatttctattaatatgggaactgtgtcttcatctttattactgttctaaggtcaactcaatgtagattttacttgcttatggtttcatattttagctaaatagt

SEQ ID NO: 4584 - DNA, 170 bp, Homo sapiens
tcacacctgaaaaatttaaatgttatgaagaaattatctcatttctattaatatgggaactgtgtcttcatctttattactgttctaaggtcaactcaatgtagattttacttgcttatggtttcatattttagctaaatagtaaaataatatggatatacattttgttg

SEQ ID NO: 4585 - DNA, 170 bp, Homo sapiens
gtgtgtgtatgtgtatgtatacatgtatgtattcagtctttactgaaattaaaaaatctttaacttgataatgggcaaatatcttagttttagatcatgtcctctagaaaccgtatgctatataattatgtactataaagtaataatgtatacagtgtaatggatcatgg

SEQ ID NO: 4586 - DNA, 170 bp, Homo sapiens
gtatgtattcagtctttactgaaattaaaaaatctttaacttgataatgggcaaatatcttagttttagatcatgtcctctagaaaccgtatgctatataattatgtactataaagtaataatgtatacagtgtaatggatcatgggccatgtgcttttcaaactaattg

SEQ ID NO: 4587 - DNA, 170 bp, Homo sapiens; identical to SEQ ID NO: 4214

SEQ ID NO: 4588 - DNA, 170 bp, Homo sapiens; identical to SEQ ID NO: 4215

SEQ ID NO: 4589 - DNA, 170 bp, Homo sapiens; identical to SEQ ID NO: 4216

SEQ ID NO: 4590 - DNA, 170 bp, Homo sapiens; identical to SEQ ID NO: 4217

SEQ ID NO: 4591 - DNA, 170 bp, Homo sapiens
ttaaaaaatctttaacttgataatgggcaaatatcttagttttagatcatgtcctctagaaaccgtatgctatataattatgtactataaagtaataatgtatacagtgtaatggatcatgggccatgtgcttttcaaactaattgtacataaaacaagcatctattgaa

SEQ ID NO: 4592 - DNA, 170 bp, Homo sapiens
gggcaaatatcttagttttagatcatgtcctctagaaaccgtatgctatataattatgtactataaagtaataatgtatacagtgtaatggatcatgggccatgtgcttttcaaactaattgtacataaaacaagcatctattgaaaatatctgacaaactcatctttta

SEQ ID NO: 4593 - DNA, 170 bp, Homo sapiens
gtcctctagaaaccgtatgctatataattatgtactataaagtaataatgtatacagtgtaatggatcatgggccatgtgcttttcaaactaattgtacataaaacaagcatctattgaaaatatctgacaaactcatcttttatttttgatgtgtgtgtgtgtgtgtgt

SEQ ID NO: 4594 - DNA, 170 bp, Homo sapiens
aattatgtactataaagtaataatgtatacagtgtaatggatcatgggccatgtgcttttcaaactaattgtacataaaacaagcatctattgaaaatatctgacaaactcatcttttatttttgatgtgtgtgtgtgtgtgtgtgtgtttttttaacagggatttgggg

SEQ ID NO: 4595 - DNA, 170 bp, Homo sapiens; identical to SEQ ID NO: 4208

SEQ ID NO: 4596 - DNA, 170 bp, Homo sapiens; identical to SEQ ID NO: 4209

SEQ ID NO: 4597 - DNA, 170 bp, Homo sapiens; identical to SEQ ID NO: 4212

SEQ ID NO: 4598 - DNA, 170 bp, Homo sapiens; identical to SEQ ID NO: 4213

SEQ ID NO: 4599 - DNA, 170 bp, Homo sapiens
tcattcagtgggtataagcagcatattctcaatactatgtttcattaataattaatagagatatatgaacacataaaagattcaattataatcaccttgtggatctaaatttcagttgacttgtcatcttgatttctggagaccacaaggtaatgaaaaataattacaag

SEQ ID NO: 4600 - DNA, 170 bp, Homo sapiens
gcatattctcaatactatgtttcattaataattaatagagatatatgaacacataaaagattcaattataatcaccttgtggatctaaatttcagttgacttgtcatcttgatttctggagaccacaaggtaatgaaaaataattacaagagtcttccatctgttgcagt

SEQ ID NO: 4601 - DNA, 170 bp, Homo sapiens
ttaataattaatagagatatatgaacacataaaagattcaattataatcaccttgtggatctaaatttcagttgacttgtcatcttgatttctggagaccacaaggtaatgaaaaataattacaagagtcttccatctgttgcagtattaaaatggcgagtaagacaccc

SEQ ID NO: 4602 - DNA, 170 bp, Homo sapiens
cacataaaagattcaattataatcaccttgtggatctaaatttcagttgacttgtcatcttgatttctggagaccacaaggtaatgaaaaataattacaagagtcttccatctgttgcagtattaaaatggcgagtaagacaccctgaaaggaaatgttctattcatggt

SEQ ID NO: 4603 - DNA, 170 bp, Homo sapiens
ccttgtggatctaaatttcagttgacttgtcatcttgatttctggagaccacaaggtaatgaaaaataattacaagagtcttccatctgttgcagtattaaaatggcgagtaagacaccctgaaaggaaatgttctattcatggtacaatgcaattacagctagcaccaa

SEQ ID NO: 4604 - DNA, 170 bp, Homo sapiens
tgtcatcttgatttctggagaccacaaggtaatgaaaaataattacaagagtcttccatctgttgcagtattaaaatggcgagtaagacaccctgaaaggaaatgttctattcatggtacaatgcaattacagctagcaccaaattcaacactgtttaactttcaacata

SEQ ID NO: 4605 - DNA, 170 bp, Homo sapiens
ggtaatgaaaaataattacaagagtcttccatctgttgcagtattaaaatggcgagtaagacaccctgaaaggaaatgttctattcatggtacaatgcaattacagctagcaccaaattcaacactgtttaactttcaacatattattttgatttatcttgatccaacat

SEQ ID NO: 4606 - DNA, 170 bp, Homo sapiens
gtcttccatctgttgcagtattaaaatggcgagtaagacaccctgaaaggaaatgttctattcatggtacaatgcaattacagctagcaccaaattcaacactgtttaactttcaacatattattttgatttatcttgatccaacattctcagggaggaggtgcattgaa

SEQ ID NO: 4607 - DNA, 170 bp, Homo sapiens
ggcgagtaagacaccctgaaaggaaatgttctattcatggtacaatgcaattacagctagcaccaaattcaacactgtttaactttcaacatattattttgatttatcttgatccaacattctcagggaggaggtgcattgaagttattagaaaacactgacttagattt

SEQ ID NO: 4608 - DNA, 170 bp, Homo sapiens
tgttctattcatggtacaatgcaattacagctagcaccaaattcaacactgtttaactttcaacatattattttgatttatcttgatccaacattctcagggaggaggtgcattgaagttattagaaaacactgacttagatttagggtatgtcttaaaagcttatttgc

SEQ ID NO: 4609 - DNA, 170 bp, Homo sapiens
gtggtaattttttaagttcccatctctggtagccaagtaaaaaaagagggtaactcattaataaaataacaaatcatatctattcaaagaatggcaccagtgtgaaaaaaagctttttaaccaatgacatttgtgatatgattattctaatttagtctttttcaggtaca

SEQ ID NO: 4610 - DNA, 170 bp, Homo sapiens
tggtagccaagtaaaaaaagagggtaactcattaataaaataacaaatcatatctattcaaagaatggcaccagtgtgaaaaaaagctttttaaccaatgacatttgtgatatgattattctaatttagtctttttcaggtacaagatattatgaaattacattttgtgt

SEQ ID NO: 4611 - DNA, 170 bp, Homo sapiens
ggtaactcattaataaaataacaaatcatatctattcaaagaatggcaccagtgtgaaaaaaagctttttaaccaatgacatttgtgatatgattattctaatttagtctttttcaggtacaagatattatgaaattacattttgtgtttatgttatttgcaatgttttc

SEQ ID NO: 4612 - DNA, 170 bp, Homo sapiens
tatctattcaaagaatggcaccagtgtgaaaaaaagctttttaaccaatgacatttgtgatatgattattctaatttagtctttttcaggtacaagatattatgaaattacattttgtgtttatgttatttgcaatgttttctatggaaatatttcacaggcaggagtcc

SEQ ID NO: 4613 - DNA, 170 bp, Homo sapiens; identical to SEQ ID NO: 4347

SEQ ID NO: 4614 - DNA, 170 bp, Homo sapiens; identical to SEQ ID NO: 4348

SEQ ID NO: 4615 - DNA, 170 bp, Homo sapiens
ctaatttagtctttttcaggtacaagatattatgaaattacattttgtgtttatgttatttgcaatgttttctatggaaatatttcacaggcaggagtccaattttcactcatcttgttacaagcttaaaaggactatggacacttcgtgccttcggacggcagccttac

SEQ ID NO: 4616 - DNA, 170 bp, Homo sapiens; identical to SEQ ID NO: 4354

SEQ ID NO: 4617 - DNA, 170 bp, Homo sapiens; identical to SEQ ID NO: 4355

SEQ ID NO: 4618 - DNA, 170 bp, Homo sapiens; identical to SEQ ID NO: 4356

SEQ ID NO: 4619 - DNA, 170 bp, Homo sapiens
aacctcaaacagacaccatggtgcatctgactcctgaggagaagtctgccgttactgccctgtggggcaaggtgaacgtggatgaagttggtggtgaggccctgggcaggttggtatcaaggttacaagacaggtttaaggagaccaatagaaactgggcatgtggagac

SEQ ID NO: 4620 - DNA, 170 bp, Homo sapiens
tgcttctgacacaactgtgttcactagcaacctcaaacagacaccatggtgcatctgactcctgaggagaagtctgccgttactgccctgtggggcaaggtgaacgtggatgaagttggtggtgaggccctgggcaggttggtatcaaggttacaagacaggtttaagga

SEQ ID NO: 4621 - DNA, 170 bp, Homo sapiens
ttgtactgatggtatggggccaagagatatatcttagagggagggctgagggtttgaagtccaactcctaagccagtgccagaagagccaaggacaggtacggctgtcatcacttagacctcaccctgtggagccacaccctagggttggccaatctactcccaggagca

SEQ ID NO: 4622 - DNA, 170 bp, Homo sapiens
aggaggatgtttttagtagcaatttgtactgatggtatggggccaagagatatatcttagagggagggctgagggtttgaagtccaactcctaagccagtgccagaagagccaaggacaggtacggctgtcatcacttagacctcaccctgtggagccacaccctagggt

SEQ ID NO: 4623 - DNA, 170 bp, Homo sapiens
tattacgtaaatacacttgcaaaggaggatgtttttagtagcaatttgtactgatggtatggggccaagagatatatcttagagggagggctgagggtttgaagtccaactcctaagccagtgccagaagagccaaggacaggtacggctgtcatcacttagacctcacc

SEQ ID NO: 4624 - DNA, 170 bp, Homo sapiens
tgcttaccaagctgtgattccaaatattacgtaaatacacttgcaaaggaggatgtttttagtagcaatttgtactgatggtatggggccaagagatatatcttagagggagggctgagggtttgaagtccaactcctaagccagtgccagaagagccaaggacaggtac

SEQ ID NO: 4625 - DNA, 170 bp, Homo sapiens
tcagggcagagccatctattgcttacatttgcttctgacacaactgtgttcactagcaacctcaaacagacaccatggtgcatctgactcctgaggagaagtctgccgttactgccctgtggggcaaggtgaacgtggatgaagttggtggtgaggccctgggcaggttg

SEQ ID NO: 4626 - DNA, 170 bp, Homo sapiens
ggcaggagccagggctgggcataaaagtcagggcagagccatctattgcttacatttgcttctgacacaactgtgttcactagcaacctcaaacagacaccatggtgcatctgactcctgaggagaagtctgccgttactgccctgtggggcaaggtgaacgtggatgaa

SEQ ID NO: 4627 - DNA, 170 bp, Homo sapiens
aatctactcccaggagcagggagggcaggagccagggctgggcataaaagtcagggcagagccatctattgcttacatttgcttctgacacaactgtgttcactagcaacctcaaacagacaccatggtgcatctgactcctgaggagaagtctgccgttactgccctgt

SEQ ID NO: 4628 - DNA, 170 bp, Homo sapiens
tggagccacaccctagggttggccaatctactcccaggagcagggagggcaggagccagggctgggcataaaagtcagggcagagccatctattgcttacatttgcttctgacacaactgtgttcactagcaacctcaaacagacaccatggtgcatctgactcctgagg

SEQ ID NO: 4629 - DNA, 170 bp, Homo sapiens
tcatcacttagacctcaccctgtggagccacaccctagggttggccaatctactcccaggagcagggagggcaggagccagggctgggcataaaagtcagggcagagccatctattgcttacatttgcttctgacacaactgtgttcactagcaacctcaaacagacacc

SEQ ID NO: 4630 - DNA, 170 bp, Homo sapiens
gtgccagaagagccaaggacaggtacggctgtcatcacttagacctcaccctgtggagccacaccctagggttggccaatctactcccaggagcagggagggcaggagccagggctgggcataaaagtcagggcagagccatctattgcttacatttgcttctgacacaa

SEQ ID NO: 4631 - DNA, 170 bp, Homo sapiens
gaagtccaactcctaagccagtgccagaagagccaaggacaggtacggctgtcatcacttagacctcaccctgtggagccacaccctagggttggccaatctactcccaggagcagggagggcaggagccagggctgggcataaaagtcagggcagagccatctattgct

SEQ ID NO: 4632 - DNA, 170 bp, Homo sapiens
gatatatcttagagggagggctgagggtttgaagtccaactcctaagccagtgccagaagagccaaggacaggtacggctgtcatcacttagacctcaccctgtggagccacaccctagggttggccaatctactcccaggagcagggagggcaggagccagggctgggc

SEQ ID NO: 4633 - DNA, 170 bp, Homo sapiens
gctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgcca

SEQ ID NO: 4634 - DNA, 170 bp, Homo sapiens
ctgcctattggtctattttcccacccttaggctgctggtggtctacccttggacccagaggttctttgagtcctttggggatctgtccactcctgatgctgttatgggcaaccctaaggtgaaggctcatggcaagaaagtgctcggtgcctttagtgatggcctggctc

SEQ ID NO: 4635 - DNA, 170 bp, Homo sapiens
ggtttctgataggcactgactctctctgcctattggtctattttcccacccttaggctgctggtggtctacccttggacccagaggttctttgagtcctttggggatctgtccactcctgatgctgttatgggcaaccctaaggtgaaggctcatggcaagaaagtgctc

SEQ ID NO: 4636 - DNA, 170 bp, Homo sapiens
atgtggagacagagaagactcttgggtttctgataggcactgactctctctgcctattggtctattttcccacccttaggctgctggtggtctacccttggacccagaggttctttgagtcctttggggatctgtccactcctgatgctgttatgggcaaccctaaggtg

SEQ ID NO: 4637 - DNA, 170 bp, Homo sapiens
tttaaggagaccaatagaaactgggcatgtggagacagagaagactcttgggtttctgataggcactgactctctctgcctattggtctattttcccacccttaggctgctggtggtctacccttggacccagaggttctttgagtcctttggggatctgtccactcctg

SEQ ID NO: 4638 - DNA, 170 bp, Homo sapiens
tcaaggttacaagacaggtttaaggagaccaatagaaactgggcatgtggagacagagaagactcttgggtttctgataggcactgactctctctgcctattggtctattttcccacccttaggctgctggtggtctacccttggacccagaggttctttgagtcctttg

SEQ ID NO: 4639 - DNA, 170 bp, Homo sapiens
tgaggccctgggcaggttggtatcaaggttacaagacaggtttaaggagaccaatagaaactgggcatgtggagacagagaagactcttgggtttctgataggcactgactctctctgcctattggtctattttcccacccttaggctgctggtggtctacccttggacc

SEQ ID NO: 4640 - DNA, 170 bp, Homo sapiens
gcaaggtgaacgtggatgaagttggtggtgaggccctgggcaggttggtatcaaggttacaagacaggtttaaggagaccaatagaaactgggcatgtggagacagagaagactcttgggtttctgataggcactgactctctctgcctattggtctattttcccaccct

SEQ ID NO: 4641 - DNA, 170 bp, Homo sapiens
tctgccgttactgccctgtggggcaaggtgaacgtggatgaagttggtggtgaggccctgggcaggttggtatcaaggttacaagacaggtttaaggagaccaatagaaactgggcatgtggagacagagaagactcttgggtttctgataggcactgactctctctgcc

SEQ ID NO: 4642 - DNA, 170 bp, Homo sapiens
ctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttggcaaagaatt

SEQ ID NO: 4643 - DNA, 170 bp, Homo sapiens
agaggtttcatattgctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgc

SEQ ID NO: 4644 - DNA, 170 bp, Homo sapiens
aattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaagg

SEQ ID NO: 4645 - DNA, 170 bp, Homo sapiens
attgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtga

SEQ ID NO: 4646 - DNA, 170 bp, Homo sapiens
ctgcatataaattgtaactgatgtaagaggtttcatattgctaatagcagctacaatccagctaccattctgcttttattttatggttgggataaggctggattattctgagtccaagctaggcccttttgctaatcatgttcatacctcttatcttcctcccacagctc

SEQ ID NO: 4647 - DNA, 170 bp, Homo sapiens
tctgcatataaatatttctgcatataaattgtaactgatgtaagaggtttcatattgctaatagcagctacaatccagctaccattctgcttttattttatggttgggataaggctggattattctgagtccaagctaggcccttttgctaatcatgttcatacctctta

SEQ ID NO: 4648 - DNA, 170 bp, Homo sapiens
tttctgggttaaggcaatagcaatatctctgcatataaatatttctgcatataaattgtaactgatgtaagaggtttcatattgctaatagcagctacaatccagctaccattctgcttttattttatggttgggataaggctggattattctgagtccaagctaggccc

SEQ ID NO: 4649 - DNA, 170 bp, Homo sapiens
gcaccattctaaagaataacagtgataatttctgggttaaggcaatagcaatatctctgcatataaatatttctgcatataaattgtaactgatgtaagaggtttcatattgctaatagcagctacaatccagctaccattctgcttttattttatggttgggataaggc

SEQ ID NO: 4650 - DNA, 170 bp, Homo sapiens
tgatacaatgtatcatgcctctttgcaccattctaaagaataacagtgataatttctgggttaaggcaatagcaatatctctgcatataaatatttctgcatataaattgtaactgatgtaagaggtttcatattgctaatagcagctacaatccagctaccattctgct

SEQ ID NO: 4651 - DNA, 170 bp, Homo sapiens
tctctttctttcagggcaataatgatacaatgtatcatgcctctttgcaccattctaaagaataacagtgataatttctgggttaaggcaatagcaatatctctgcatataaatatttctgcatataaattgtaactgatgtaagaggtttcatattgctaatagcagct

SEQ ID NO: 4652 - DNA, 170 bp, Homo sapiens
ttgtttatcttatttctaatactttccctaatctctttctttcagggcaataatgatacaatgtatcatgcctctttgcaccattctaaagaataacagtgataatttctgggttaaggcaatagcaatatctctgcatataaatatttctgcatataaattgtaactga

SEQ ID NO: 4653 - DNA, 170 bp, Homo sapiens
tgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatctctgcatataaat

SEQ ID NO: 4654 - DNA, 170 bp, Homo sapiens
cacagacccaataattagaactgtttggtctctggctagactgtgagctccttgcaggtggggaagatgtcatgtatgcttttaccctccacccaaatgcccagcacaggaggaccaggattggaacaagtgttgacctctcatgtttactttgtttcagaattgggggg

SEQ ID NO: 4655 - DNA, 170 bp, Homo sapiens
ggtctctggctagactgtgagctccttgcaggtggggaagatgtcatgtatgcttttaccctccacccaaatgcccagcacaggaggaccaggattggaacaagtgttgacctctcatgtttactttgtttcagaattggggggttctatgctctttccccataccccgg

SEQ ID NO: 4656 - DNA, 170 bp, Homo sapiens
gcaggtggggaagatgtcatgtatgcttttaccctccacccaaatgcccagcacaggaggaccaggattggaacaagtgttgacctctcatgtttactttgtttcagaattggggggttctatgctctttccccataccccggtctccgcctcatctctctcaatatgaa

SEQ ID NO: 4657 - DNA, 170 bp, Homo sapiens
tgcttttaccctccacccaaatgcccagcacaggaggaccaggattggaacaagtgttgacctctcatgtttactttgtttcagaattggggggttctatgctctttccccataccccggtctccgcctcatctctctcaatatgaatttttgttcccgtgagaacttct

SEQ ID NO: 4658 - DNA, 170 bp, Homo sapiens
agcacaggaggaccaggattggaacaagtgttgacctctcatgtttactttgtttcagaattggggggttctatgctctttccccataccccggtctccgcctcatctctctcaatatgaatttttgttcccgtgagaacttctggctcttgatcaactccacggatccc

SEQ ID NO: 4659 - DNA, 170 bp, Homo sapiens
acaagtgttgacctctcatgtttactttgtttcagaattggggggttctatgctctttccccataccccggtctccgcctcatctctctcaatatgaatttttgttcccgtgagaacttctggctcttgatcaactccacggatcccgcaggacagctccagtggctggt

SEQ ID NO: 4660 - DNA, 170 bp, Homo sapiens
tgtttcagaattggggggttctatgctctttccccataccccggtctccgcctcatctctctcaatatgaatttttgttcccgtgagaacttctggctcttgatcaactccacggatcccgcaggacagctccagtggctggtgggggagcttcaggctgctgaggatcg

SEQ ID NO: 4661 - DNA, 170 bp, Homo sapiens
ctctttccccataccccggtctccgcctcatctctctcaatatgaatttttgttcccgtgagaacttctggctcttgatcaactccacggatcccgcaggacagctccagtggctggtgggggagcttcaggctgctgaggatcgaggagacaaagtgagggccagtagt

SEQ ID NO: 4662 - DNA, 170 bp, Homo sapiens
tccgcctcatctctctcaatatgaatttttgttcccgtgagaacttctggctcttgatcaactccacggatcccgcaggacagctccagtggctggtgggggagcttcaggctgctgaggatcgaggagacaaagtgagggccagtagtgggaacacggtggtgctgggg

SEQ ID NO: 4663 - DNA, 170 bp, Homo sapiens
ttgttcccgtgagaacttctggctcttgatcaactccacggatcccgcaggacagctccagtggctggtgggggagcttcaggctgctgaggatcgaggagacaaagtgagggccagtagtgggaacacggtggtgctgggggacaagcaggctcctgttgagctggagc

SEQ ID NO: 4664 - DNA, 170 bp, Homo sapiens
tcaactccacggatcccgcaggacagctccagtggctggtgggggagcttcaggctgctgaggatcgaggagacaaagtgagggccagtagtgggaacacggtggtgctgggggacaagcaggctcctgttgagctggagcacctctgggcacagaagttttattttcct

SEQ ID NO: 4665 - DNA, 170 bp, Homo sapiens
agctccagtggctggtgggggagcttcaggctgctgaggatcgaggagacaaagtgagggccagtagtgggaacacggtggtgctgggggacaagcaggctcctgttgagctggagcacctctgggcacagaagttttattttcctggcattcccaacaagtgttccctg

SEQ ID NO: 4666 - DNA, 170 bp, Homo sapiens
tcaggctgctgaggatcgaggagacaaagtgagggccagtagtgggaacacggtggtgctgggggacaagcaggctcctgttgagctggagcacctctgggcacagaagttttattttcctggcattcccaacaagtgttccctggggattcagctcatggtcactgttg

SEQ ID NO: 4667 - DNA, 170 bp, Homo sapiens
gccctttcggttctcatgtaagtagcaattgcatttgagttatttaatgctttaggcagactcttcccagtgttgcgaggaattatatttgagaattttgccgtgtttactgcaggactttttaaatcggtgtgaaccatatgaaaaacctatgactctgagcaatttct

SEQ ID NO: 4668 - DNA, 170 bp, Homo sapiens
tgaggcagtgtgggttgggagcaaggccctttcggttctcatgtaagtagcaattgcatttgagttatttaatgctttaggcagactcttcccagtgttgcgaggaattatatttgagaattttgccgtgtttactgcaggactttttaaatcggtgtgaaccatatgaa

SEQ ID NO: 4669 - DNA, 170 bp, Homo sapiens
gtacgggcttttccacggagagggtgtgaggcagtgtgggttgggagcaaggccctttcggttctcatgtaagtagcaattgcatttgagttatttaatgctttaggcagactcttcccagtgttgcgaggaattatatttgagaattttgccgtgtttactgcaggact

SEQ ID NO: 4670 - DNA, 170 bp, Homo sapiens
tggacaagtttatgggtgaaatgcagtacgggcttttccacggagagggtgtgaggcagtgtgggttgggagcaaggccctttcggttctcatgtaagtagcaattgcatttgagttatttaatgctttaggcagactcttcccagtgttgcgaggaattatatttgaga

SEQ ID NO: 4671 - DNA, 170 bp, Homo sapiens
cgtcaatgcctcagggcaggagctggacaagtttatgggtgaaatgcagtacgggcttttccacggagagggtgtgaggcagtgtgggttgggagcaaggccctttcggttctcatgtaagtagcaattgcatttgagttatttaatgctttaggcagactcttcccagt

SEQ ID NO: 4672 - DNA, 170 bp, Homo sapiens
gtcctctgcaaaacgggagctctgctcgtcaatgcctcagggcaggagctggacaagtttatgggtgaaatgcagtacgggcttttccacggagagggtgtgaggcagtgtgggttgggagcaaggccctttcggttctcatgtaagtagcaattgcatttgagttattt

SEQ ID NO: 4673 - DNA, 170 bp, Homo sapiens
gggacaccgttgtggatcaaagccactgtcctctgcaaaacgggagctctgctcgtcaatgcctcagggcaggagctggacaagtttatgggtgaaatgcagtacgggcttttccacggagagggtgtgaggcagtgtgggttgggagcaaggccctttcggttctcatg

SEQ ID NO: 4674 - DNA, 170 bp, Homo sapiens
gccctcggagttgtgacagccttggggacaccgttgtggatcaaagccactgtcctctgcaaaacgggagctctgctcgtcaatgcctcagggcaggagctggacaagtttatgggtgaaatgcagtacgggcttttccacggagagggtgtgaggcagtgtgggttggg

SEQ ID NO: 4675 - DNA, 170 bp, Homo sapiens
tggccggagtgttcagttttgcatgtgccctcggagttgtgacagccttggggacaccgttgtggatcaaagccactgtcctctgcaaaacgggagctctgctcgtcaatgcctcagggcaggagctggacaagtttatgggtgaaatgcagtacgggcttttccacgga

SEQ ID NO: 4676 - DNA, 170 bp, Homo sapiens
gccaacagaagaaaatcattttttgcatggccggagtgttcagttttgcatgtgccctcggagttgtgacagccttggggacaccgttgtggatcaaagccactgtcctctgcaaaacgggagctctgctcgtcaatgcctcagggcaggagctggacaagtttatgggt

SEQ ID NO: 4677 - DNA, 170 bp, Homo sapiens
gaagccgtttctcatcatgccaagccaacagaagaaaatcattttttgcatggccggagtgttcagttttgcatgtgccctcggagttgtgacagccttggggacaccgttgtggatcaaagccactgtcctctgcaaaacgggagctctgctcgtcaatgcctcagggc

SEQ ID NO: 4678 - DNA, 170 bp, Homo sapiens
tgtttttgaacctcgccctcacagaagccgtttctcatcatgccaagccaacagaagaaaatcattttttgcatggccggagtgttcagttttgcatgtgccctcggagttgtgacagccttggggacaccgttgtggatcaaagccactgtcctctgcaaaacgggagc

SEQ ID NO: 4679 - DNA, 170 bp, Homo sapiens
gtcccttcccattgctcacaaaggtcttgtttttgaacctcgccctcacagaagccgtttctcatcatgccaagccaacagaagaaaatcattttttgcatggccggagtgttcagttttgcatgtgccctcggagttgtgacagccttggggacaccgttgtggatcaa

SEQ ID NO: 4680 - DNA, 170 bp, Homo sapiens
gtaataaatgcagtcaaagaggcagtcccttcccattgctcacaaaggtcttgtttttgaacctcgccctcacagaagccgtttctcatcatgccaagccaacagaagaaaatcattttttgcatggccggagtgttcagttttgcatgtgccctcggagttgtgacagc

SEQ ID NO: 4681 - DNA, 170 bp, Homo sapiens
ctgggagctgtccgttcagcttccgtaataaatgcagtcaaagaggcagtcccttcccattgctcacaaaggtcttgtttttgaacctcgccctcacagaagccgtttctcatcatgccaagccaacagaagaaaatcattttttgcatggccggagtgttcagttttgc

SEQ ID NO: 4682 - DNA, 170 bp, Homo sapiens
cgatggtgaagttgccttttcagctgggagctgtccgttcagcttccgtaataaatgcagtcaaagaggcagtcccttcccattgctcacaaaggtcttgtttttgaacctcgccctcacagaagccgtttctcatcatgccaagccaacagaagaaaatcattttttgc

SEQ ID NO: 4683 - DNA, 170 bp, Homo sapiens
aatgtactgaaaggcaaacctttctataattttacaagggagtagacttgctttggtcacttttagatgtggttaattttgcatatccttttagtctgcatatattaaagcatcaggacccttcgtgacaatgtttacaaattacgtactaaggatacaggctggaaagt

SEQ ID NO: 4684 - DNA, 170 bp, Homo sapiens
acaactaatgtagctgcagatctaatgtactgaaaggcaaacctttctataattttacaagggagtagacttgctttggtcacttttagatgtggttaattttgcatatccttttagtctgcatatattaaagcatcaggacccttcgtgacaatgtttacaaattacgt

SEQ ID NO: 4685 - DNA, 170 bp, Homo sapiens
ccttttgcaaaatctaaagacgcagaaacaactaatgtagctgcagatctaatgtactgaaaggcaaacctttctataattttacaagggagtagacttgctttggtcacttttagatgtggttaattttgcatatccttttagtctgcatatattaaagcatcaggacc

SEQ ID NO: 4686 - DNA, 170 bp, Homo sapiens
acgacttgctggatttcagttcccttttgcaaaatctaaagacgcagaaacaactaatgtagctgcagatctaatgtactgaaaggcaaacctttctataattttacaagggagtagacttgctttggtcacttttagatgtggttaattttgcatatccttttagtctg

SEQ ID NO: 4687 - DNA, 170 bp, Homo sapiens
ttgttcattttctgaatgggctcctaatacgacttgctggatttcagttcccttttgcaaaatctaaagacgcagaaacaactaatgtagctgcagatctaatgtactgaaaggcaaacctttctataattttacaagggagtagacttgctttggtcacttttagatgt

SEQ ID NO: 4688 - DNA, 170 bp, Homo sapiens
tctgggtcattttcttttgcttttttgttcattttctgaatgggctcctaatacgacttgctggatttcagttcccttttgcaaaatctaaagacgcagaaacaactaatgtagctgcagatctaatgtactgaaaggcaaacctttctataattttacaagggagtaga

SEQ ID NO: 4689 - DNA, 170 bp, Homo sapiens
cgcaaagtgaaaaatataccacctcattctgggtcattttcttttgcttttttgttcattttctgaatgggctcctaatacgacttgctggatttcagttcccttttgcaaaatctaaagacgcagaaacaactaatgtagctgcagatctaatgtactgaaaggcaaac

SEQ ID NO: 4690 - DNA, 170 bp, Homo sapiens
aagaagggacttatgtctacaaaacgcaaagtgaaaaatataccacctcattctgggtcattttcttttgcttttttgttcattttctgaatgggctcctaatacgacttgctggatttcagttcccttttgcaaaatctaaagacgcagaaacaactaatgtagctgca

SEQ ID NO: 4691 - DNA, 170 bp, Homo sapiens
cctctcagaaaaaattgcaaattataaagaagggacttatgtctacaaaacgcaaagtgaaaaatataccacctcattctgggtcattttcttttgcttttttgttcattttctgaatgggctcctaatacgacttgctggatttcagttcccttttgcaaaatctaaag

SEQ ID NO: 4692 - DNA, 170 bp, Homo sapiens
tgcctctgaagtgaaaatccatcacctctcagaaaaaattgcaaattataaagaagggacttatgtctacaaaacgcaaagtgaaaaatataccacctcattctgggtcattttcttttgcttttttgttcattttctgaatgggctcctaatacgacttgctggatttc

SEQ ID NO: 4693 - DNA, 170 bp, Homo sapiens
tggctgtcttgtcatgatattgtttgcctctgaagtgaaaatccatcacctctcagaaaaaattgcaaattataaagaagggacttatgtctacaaaacgcaaagtgaaaaatataccacctcattctgggtcattttcttttgcttttttgttcattttctgaatgggc

SEQ ID NO: 4694 - DNA, 170 bp, Homo sapiens
ttgtttcttctgttgcaggctcctgtggctgtcttgtcatgatattgtttgcctctgaagtgaaaatccatcacctctcagaaaaaattgcaaattataaagaagggacttatgtctacaaaacgcaaagtgaaaaatataccacctcattctgggtcattttcttttgc

SEQ ID NO: 4695 - DNA, 170 bp, Homo sapiens
gtagaaccgcgcgggccaatcgcgctgctcccgggtgatgacgtaggctgcgcctgtgcatgcgcagggaggggagaccttggcggagcggcggaggcgcccagcggaggtgaaagtattggcggaaaggaaaatacagcggaaaaatgcagagctggagtcgtgtgtac

SEQ ID NO: 4696 - DNA, 170 bp, Homo sapiens
cgctgctcccgggtgatgacgtaggctgcgcctgtgcatgcgcagggaggggagaccttggcggagcggcggaggcgcccagcggaggtgaaagtattggcggaaaggaaaatacagcggaaaaatgcagagctggagtcgtgtgtactgctccttggccaaggtgaggg

SEQ ID NO: 4697 - DNA, 170 bp, Homo sapiens
tgcgcctgtgcatgcgcagggaggggagaccttggcggagcggcggaggcgcccagcggaggtgaaagtattggcggaaaggaaaatacagcggaaaaatgcagagctggagtcgtgtgtactgctccttggccaaggtgagggccgagtaggtgaggtcgtgttgagcc

SEQ ID NO: 4698 - DNA, 170 bp, Homo sapiens
ggagaccttggcggagcggcggaggcgcccagcggaggtgaaagtattggcggaaaggaaaatacagcggaaaaatgcagagctggagtcgtgtgtactgctccttggccaaggtgagggccgagtaggtgaggtcgtgttgagccagaggcacggaaggtcccgctcag

SEQ ID NO: 4699 - DNA, 170 bp, Homo sapiens
ggcgcccagcggaggtgaaagtattggcggaaaggaaaatacagcggaaaaatgcagagctggagtcgtgtgtactgctccttggccaaggtgagggccgagtaggtgaggtcgtgttgagccagaggcacggaaggtcccgctcagtgggtccggtacgcggcttaacc

SEQ ID NO: 4700 - DNA, 170 bp, Homo sapiens
attggcggaaaggaaaatacagcggaaaaatgcagagctggagtcgtgtgtactgctccttggccaaggtgagggccgagtaggtgaggtcgtgttgagccagaggcacggaaggtcccgctcagtgggtccggtacgcggcttaaccgtgttgggctggcggaggcggg

SEQ ID NO: 4701 - DNA, 170 bp, Homo sapiens
aaaatgcagagctggagtcgtgtgtactgctccttggccaaggtgagggccgagtaggtgaggtcgtgttgagccagaggcacggaaggtcccgctcagtgggtccggtacgcggcttaaccgtgttgggctggcggaggcgggcgcctgggccgcaccacccctggccc

SEQ ID NO: 4702 - DNA, 170 bp, Homo sapiens
tctgtctcaaaaacaaaacaaaacaaaaatgaaaatgtcatcaacacttgagaaattgctggccttaaatttctaagcctatcaatttatgtaggtgtgtatttaacatttatacactgtttgttatctagtattgaagctgcttctggtggtaaagctgaagttatcac

SEQ ID NO: 4703 - DNA, 170 bp, Homo sapiens
caaaaatgaaaatgtcatcaacacttgagaaattgctggccttaaatttctaagcctatcaatttatgtaggtgtgtatttaacatttatacactgtttgttatctagtattgaagctgcttctggtggtaaagctgaagttatcacttgtgatgtactcttggtttgca

SEQ ID NO: 4704 - DNA, 170 bp, Homo sapiens
agaggtagaattccagtcaataccagatttcaaactaaaattccaaagtaagttggataattgtctgcattttcagtaattttaaaattgatttcaaacagtattttgaaaagtaagatttttatgcttaaaatatgtattggctttggggaagaatagtaaacttacaa

SEQ ID NO: 4705 - DNA, 170 bp, Homo sapiens
accagatttcaaactaaaattccaaagtaagttggataattgtctgcattttcagtaattttaaaattgatttcaaacagtattttgaaaagtaagatttttatgcttaaaatatgtattggctttggggaagaatagtaaacttacaaaatgtaaaataaaaaataact

SEQ ID NO: 4706 - DNA, 170 bp, Homo sapiens
tgagaaattgctggccttaaatttctaagcctatcaatttatgtaggtgtgtatttaacatttatacactgtttgttatctagtattgaagctgcttctggtggtaaagctgaagttatcacttgtgatgtactcttggtttgcattggccgacgaccctttactaagaa

SEQ ID NO: 4707 - DNA, 170 bp, Homo sapiens
tctaagcctatcaatttatgtaggtgtgtatttaacatttatacactgtttgttatctagtattgaagctgcttctggtggtaaagctgaagttatcacttgtgatgtactcttggtttgcattggccgacgaccctttactaagaatttgggactagaagagctgggaa

SEQ ID NO: 4708 - DNA, 170 bp, Homo sapiens
tgtgtatttaacatttatacactgtttgttatctagtattgaagctgcttctggtggtaaagctgaagttatcacttgtgatgtactcttggtttgcattggccgacgaccctttactaagaatttgggactagaagagctgggaattgaactagatcccagaggtagaa

SEQ ID NO: 4709 - DNA, 170 bp, Homo sapiens
tctagtattgaagctgcttctggtggtaaagctgaagttatcacttgtgatgtactcttggtttgcattggccgacgaccctttactaagaatttgggactagaagagctgggaattgaactagatcccagaggtagaattccagtcaataccagatttcaaactaaaat

SEQ ID NO: 4710 - DNA, 170 bp, Homo sapiens
ggtaaagctgaagttatcacttgtgatgtactcttggtttgcattggccgacgaccctttactaagaatttgggactagaagagctgggaattgaactagatcccagaggtagaattccagtcaataccagatttcaaactaaaattccaaagtaagttggataattgtc

SEQ ID NO: 4711 - DNA, 170 bp, Homo sapiens
tgtactcttggtttgcattggccgacgaccctttactaagaatttgggactagaagagctgggaattgaactagatcccagaggtagaattccagtcaataccagatttcaaactaaaattccaaagtaagttggataattgtctgcattttcagtaattttaaaattga

SEQ ID NO: 4712 - DNA, 170 bp, Homo sapiens
gacgaccctttactaagaatttgggactagaagagctgggaattgaactagatcccagaggtagaattccagtcaataccagatttcaaactaaaattccaaagtaagttggataattgtctgcattttcagtaattttaaaattgatttcaaacagtattttgaaaagt

SEQ ID NO: 4713 - DNA, 170 bp, Homo sapiens
aagagctgggaattgaactagatcccagaggtagaattccagtcaataccagatttcaaactaaaattccaaagtaagttggataattgtctgcattttcagtaattttaaaattgatttcaaacagtattttgaaaagtaagatttttatgcttaaaatatgtattggc

SEQ ID NO: 4714 - DNA, 170 bp, Homo sapiens
tgaattcatagatttttgaagagctgcatttgatgtattttttggtgacttgtttactggaaacttttgttaccataatgtaactgaaggtaagtagctgtgatttcagaaattcattgtgtttcttttgatttctgtggtagtatctatgccattggtgatgtagttgc

SEQ ID NO: 4715 - DNA, 170 bp, Homo sapiens
tgcatttgatgtattttttggtgacttgtttactggaaacttttgttaccataatgtaactgaaggtaagtagctgtgatttcagaaattcattgtgtttcttttgatttctgtggtagtatctatgccattggtgatgtagttgctggtccaatgctggctcacaaagc

SEQ ID NO: 4716 - DNA, 170 bp, Homo sapiens
acaattgtgtgccatcagtgatttacacacaccctgaagttgcttgggttggcaaatcagaagagcagttgaaagaagaggtaagtctgaacatgggtggttttaagccaatgtgtgagttgtgccaatgacattggtggttgagaaacagcattttatcattatgctaa

SEQ ID NO: 4717 - DNA, 170 bp, Homo sapiens
acacaccctgaagttgcttgggttggcaaatcagaagagcagttgaaagaagaggtaagtctgaacatgggtggttttaagccaatgtgtgagttgtgccaatgacattggtggttgagaaacagcattttatcattatgctaatatatttaacagctgtgaaatattgt

SEQ ID NO: 4718 - DNA, 170 bp, Homo sapiens
ggcaaatcagaagagcagttgaaagaagaggtaagtctgaacatgggtggttttaagccaatgtgtgagttgtgccaatgacattggtggttgagaaacagcattttatcattatgctaatatatttaacagctgtgaaatattgtttagcttatatatttttcccttgt

SEQ ID NO: 4719 - DNA, 170 bp, Homo sapiens
gtttactggaaacttttgttaccataatgtaactgaaggtaagtagctgtgatttcagaaattcattgtgtttcttttgatttctgtggtagtatctatgccattggtgatgtagttgctggtccaatgctggctcacaaagcagaggatgaaggcattatctgtgttga

SEQ ID NO: 4720 - DNA, 170 bp, Homo sapiens
taatgtaactgaaggtaagtagctgtgatttcagaaattcattgtgtttcttttgatttctgtggtagtatctatgccattggtgatgtagttgctggtccaatgctggctcacaaagcagaggatgaaggcattatctgtgttgaaggaatggctggtggtgctgtgca

SEQ ID NO: 4721 - DNA, 170 bp, Homo sapiens
tgatttcagaaattcattgtgtttcttttgatttctgtggtagtatctatgccattggtgatgtagttgctggtccaatgctggctcacaaagcagaggatgaaggcattatctgtgttgaaggaatggctggtggtgctgtgcacattgactacaattgtgtgccatca

SEQ ID NO: 4722 - DNA, 170 bp, Homo sapiens
tttgatttctgtggtagtatctatgccattggtgatgtagttgctggtccaatgctggctcacaaagcagaggatgaaggcattatctgtgttgaaggaatggctggtggtgctgtgcacattgactacaattgtgtgccatcagtgatttacacacaccctgaagttgc

SEQ ID NO: 4723 - DNA, 170 bp, Homo sapiens
ttggtgatgtagttgctggtccaatgctggctcacaaagcagaggatgaaggcattatctgtgttgaaggaatggctggtggtgctgtgcacattgactacaattgtgtgccatcagtgatttacacacaccctgaagttgcttgggttggcaaatcagaagagcagttg

SEQ ID NO: 4724 - DNA, 170 bp, Homo sapiens
caatgctggctcacaaagcagaggatgaaggcattatctgtgttgaaggaatggctggtggtgctgtgcacattgactacaattgtgtgccatcagtgatttacacacaccctgaagttgcttgggttggcaaatcagaagagcagttgaaagaagaggtaagtctgaac

SEQ ID NO: 4725 - DNA, 170 bp, Homo sapiens
aggcattatctgtgttgaaggaatggctggtggtgctgtgcacattgactacaattgtgtgccatcagtgatttacacacaccctgaagttgcttgggttggcaaatcagaagagcagttgaaagaagaggtaagtctgaacatgggtggttttaagccaatgtgtgagt

SEQ ID NO: 4726 - DNA, 170 bp, Homo sapiens
ctggtggtgctgtgcacattgactacaattgtgtgccatcagtgatttacacacaccctgaagttgcttgggttggcaaatcagaagagcagttgaaagaagaggtaagtctgaacatgggtggttttaagccaatgtgtgagttgtgccaatgacattggtggttgaga

SEQ ID NO: 4727 - DNA, 170 bp, Homo sapiens
tttcctttccttctatgtgctttgcgaacaattcccttcttgggatttattttctgaacaaatggtagatgattttacaaattggaaagaacttttctggcagttacgtagattctttttttctgactgtcacagggtattgagtacaaagttgggaaattcccatttgc

SEQ ID NO: 4728 - DNA, 170 bp, Homo sapiens
gcgaacaattcccttcttgggatttattttctgaacaaatggtagatgattttacaaattggaaagaacttttctggcagttacgtagattctttttttctgactgtcacagggtattgagtacaaagttgggaaattcccatttgctgctaacagcagagctaagacaa

SEQ ID NO: 4729 - DNA, 170 bp, Homo sapiens
tgggagcacatattcttggaccagtgagtattgtaaaaccagagaaatcccattaagatttctagaaagcattgctgtttattaattataaaccacctggtgttagtctgaggttgctcatttccagcaaaactttgaatatggctctctgtgcatcatttctagaagga

SEQ ID NO: 4730 - DNA, 170 bp, Homo sapiens
ttttctgaacaaatggtagatgattttacaaattggaaagaacttttctggcagttacgtagattctttttttctgactgtcacagggtattgagtacaaagttgggaaattcccatttgctgctaacagcagagctaagacaaatgctgacacagatggcatggtgaag

SEQ ID NO: 4731 - DNA, 170 bp, Homo sapiens
tttacaaattggaaagaacttttctggcagttacgtagattctttttttctgactgtcacagggtattgagtacaaagttgggaaattcccatttgctgctaacagcagagctaagacaaatgctgacacagatggcatggtgaagatccttgggcagaaatcgacagac

SEQ ID NO: 4732 - DNA, 170 bp, Homo sapiens
gcagttacgtagattctttttttctgactgtcacagggtattgagtacaaagttgggaaattcccatttgctgctaacagcagagctaagacaaatgctgacacagatggcatggtgaagatccttgggcagaaatcgacagacagagtactgggagcacatattcttgg

SEQ ID NO: 4733 - DNA, 170 bp, Homo sapiens
actgtcacagggtattgagtacaaagttgggaaattcccatttgctgctaacagcagagctaagacaaatgctgacacagatggcatggtgaagatccttgggcagaaatcgacagacagagtactgggagcacatattcttggaccagtgagtattgtaaaaccagaga

SEQ ID NO: 4734 - DNA, 170 bp, Homo sapiens
ttgggaaattcccatttgctgctaacagcagagctaagacaaatgctgacacagatggcatggtgaagatccttgggcagaaatcgacagacagagtactgggagcacatattcttggaccagtgagtattgtaaaaccagagaaatcccattaagatttctagaaagca

SEQ ID NO: 4735 - DNA, 170 bp, Homo sapiens
agcagagctaagacaaatgctgacacagatggcatggtgaagatccttgggcagaaatcgacagacagagtactgggagcacatattcttggaccagtgagtattgtaaaaccagagaaatcccattaagatttctagaaagcattgctgtttattaattataaaccacc

SEQ ID NO: 4736 - DNA, 170 bp, Homo sapiens
acacagatggcatggtgaagatccttgggcagaaatcgacagacagagtactgggagcacatattcttggaccagtgagtattgtaaaaccagagaaatcccattaagatttctagaaagcattgctgtttattaattataaaccacctggtgttagtctgaggttgctc

SEQ ID NO: 4737 - DNA, 170 bp, Homo sapiens
gggcagaaatcgacagacagagtactgggagcacatattcttggaccagtgagtattgtaaaaccagagaaatcccattaagatttctagaaagcattgctgtttattaattataaaccacctggtgttagtctgaggttgctcatttccagcaaaactttgaatatggc

SEQ ID NO: 4738 - DNA, 170 bp, Homo sapiens
ctattaagcttttcctgacttttcttcaactgataaagaaacagatttaaggcgtttttaagatctaaaagcttcccctcaacaattgctatcctattagcatgtagtttttgccttggaagcaaatttacttggcttgttattttaaagggtgctggagaaatggtaaa

SEQ ID NO: 4739 - DNA, 170 bp, Homo sapiens
tcttcaactgataaagaaacagatttaaggcgtttttaagatctaaaagcttcccctcaacaattgctatcctattagcatgtagtttttgccttggaagcaaatttacttggcttgttattttaaagggtgctggagaaatggtaaatgaagctgctcttgctttggaa

SEQ ID NO: 4740 - DNA, 170 bp, Homo sapiens
aggcgtttttaagatctaaaagcttcccctcaacaattgctatcctattagcatgtagtttttgccttggaagcaaatttacttggcttgttattttaaagggtgctggagaaatggtaaatgaagctgctcttgctttggaatatggagcatcctgtgaagatatagct

SEQ ID NO: 4741 - DNA, 170 bp, Homo sapiens
tcccctcaacaattgctatcctattagcatgtagtttttgccttggaagcaaatttacttggcttgttattttaaagggtgctggagaaatggtaaatgaagctgctcttgctttggaatatggagcatcctgtgaagatatagctagagtctgtcatgcacatccggta

SEQ ID NO: 4742 - DNA, 170 bp, Homo sapiens
tgtagtttttgccttggaagcaaatttacttggcttgttattttaaagggtgctggagaaatggtaaatgaagctgctcttgctttggaatatggagcatcctgtgaagatatagctagagtctgtcatgcacatccggtaattattaacaacatatagaattgatggtt

SEQ ID NO: 4743 - DNA, 170 bp, Homo sapiens
tttacttggcttgttattttaaagggtgctggagaaatggtaaatgaagctgctcttgctttggaatatggagcatcctgtgaagatatagctagagtctgtcatgcacatccggtaattattaacaacatatagaattgatggttgcctaaattttcttctgacccaca

SEQ ID NO: 4744 - DNA, 170 bp, Homo sapiens
tgctggagaaatggtaaatgaagctgctcttgctttggaatatggagcatcctgtgaagatatagctagagtctgtcatgcacatccggtaattattaacaacatatagaattgatggttgcctaaattttcttctgacccacaaatatttggattttaattttaaattt

SEQ ID NO: 4745 - DNA, 170 bp, Homo sapiens
gctgctcttgctttggaatatggagcatcctgtgaagatatagctagagtctgtcatgcacatccggtaattattaacaacatatagaattgatggttgcctaaattttcttctgacccacaaatatttggattttaattttaaatttcttcccttgcagaccttatcag

SEQ ID NO: 4746 - DNA, 170 bp, Homo sapiens
tcctgtgaagatatagctagagtctgtcatgcacatccggtaattattaacaacatatagaattgatggttgcctaaattttcttctgacccacaaatatttggattttaattttaaatttcttcccttgcagaccttatcagaagcttttagagaagcaaatcttgctg

SEQ ID NO: 4747 - DNA, 170 bp, Homo sapiens
tgtgaagatatagctagagtctgtcatgcacatccggtaattattaacaacatatagaattgatggttgcctaaattttcttctgacccacaaatatttggattttaattttaaatttcttcccttgcagaccttatcagaagcttttagagaagcaaatcttgctgcgt

SEQ ID NO: 4748 - DNA, 170 bp, Homo sapiens
gcacatccggtaattattaacaacatatagaattgatggttgcctaaattttcttctgacccacaaatatttggattttaattttaaatttcttcccttgcagaccttatcagaagcttttagagaagcaaatcttgctgcgtcatttggcaaatcaatcaacttttgaa

SEQ ID NO: 4749 - DNA, 170 bp, Homo sapiens
atagaattgatggttgcctaaattttcttctgacccacaaatatttggattttaattttaaatttcttcccttgcagaccttatcagaagcttttagagaagcaaatcttgctgcgtcatttggcaaatcaatcaacttttgaattagaagattatatatatttttttct

SEQ ID NO: 4750 - DNA, 170 bp, Homo sapiens
tcttctgacccacaaatatttggattttaattttaaatttcttcccttgcagaccttatcagaagcttttagagaagcaaatcttgctgcgtcatttggcaaatcaatcaacttttgaattagaagattatatatatttttttctgaaatttcctgggagcttttgtaga

SEQ ID NO: 4751 - DNA, 170 bp, Homo sapiens
ttaattttaaatttcttcccttgcagaccttatcagaagcttttagagaagcaaatcttgctgcgtcatttggcaaatcaatcaacttttgaattagaagattatatatatttttttctgaaatttcctgggagcttttgtagaagtcacattcctgaacaggatattct

SEQ ID NO: 4752 - DNA, 170 bp, Homo sapiens
agaccttatcagaagcttttagagaagcaaatcttgctgcgtcatttggcaaatcaatcaacttttgaattagaagattatatatatttttttctgaaatttcctgggagcttttgtagaagtcacattcctgaacaggatattctcacagctccaagaatttctaggac

SEQ ID NO: 4753 - DNA, 170 bp, Homo sapiens
tcttgctgcgtcatttggcaaatcaatcaacttttgaattagaagattatatatatttttttctgaaatttcctgggagcttttgtagaagtcacattcctgaacaggatattctcacagctccaagaatttctaggactgaattatgaaacttttggaaggtatttaat

SEQ ID NO: 4754 - DNA, 170 bp, Homo sapiens
tctgtgtggcaatggaagaagatacactaataatcctcgcttgatacgtttgcccaaaattgttctgttatcatcaaccttcagtagttctatgttttgaattcatatcttacataatagggacattttctttttctagagaggccatttcaatcgaatatctcatggcc

SEQ ID NO: 4755 - DNA, 170 bp, Homo sapiens
tacactaataatcctcgcttgatacgtttgcccaaaattgttctgttatcatcaaccttcagtagttctatgttttgaattcatatcttacataatagggacattttctttttctagagaggccatttcaatcgaatatctcatggcctacagggactttctgcagtgcc

SEQ ID NO: 4756 - DNA, 170 bp, Homo sapiens
gtttgcccaaaattgttctgttatcatcaaccttcagtagttctatgttttgaattcatatcttacataatagggacattttctttttctagagaggccatttcaatcgaatatctcatggcctacagggactttctgcagtgcctctgagaacttacgcagatcagccg

SEQ ID NO: 4757 - DNA, 170 bp, Homo sapiens
caaccttcagtagttctatgttttgaattcatatcttacataatagggacattttctttttctagagaggccatttcaatcgaatatctcatggcctacagggactttctgcagtgcctctgagaacttacgcagatcagccgagtaagtacttaagtaaaacatttttt

SEQ ID NO: 4758 - DNA, 170 bp, Homo sapiens
tgaattcatatcttacataatagggacattttctttttctagagaggccatttcaatcgaatatctcatggcctacagggactttctgcagtgcctctgagaacttacgcagatcagccgagtaagtacttaagtaaaacatttttttcatcacattagctgacagttcc

SEQ ID NO: 4759 - DNA, 170 bp, Homo sapiens
cattttctttttctagagaggccatttcaatcgaatatctcatggcctacagggactttctgcagtgcctctgagaacttacgcagatcagccgagtaagtacttaagtaaaacatttttttcatcacattagctgacagttcctttctatttcaatgtaaaagcaagtg

SEQ ID NO: 4760 - DNA, 170 bp, Homo sapiens
caatcgaatatctcatggcctacagggactttctgcagtgcctctgagaacttacgcagatcagccgagtaagtacttaagtaaaacatttttttcatcacattagctgacagttcctttctatttcaatgtaaaagcaagtgaatattggaataacttatgttaagtgt

SEQ ID NO: 4761 - DNA, 170 bp, Homo sapiens
ggactttctgcagtgcctctgagaacttacgcagatcagccgagtaagtacttaagtaaaacatttttttcatcacattagctgacagttcctttctatttcaatgtaaaagcaagtgaatattggaataacttatgttaagtgtcttatagttcatttgttcatgtatt

SEQ ID NO: 4762 - DNA, 170 bp, Homo sapiens
agtgcagaaactatgtagaaaatgctgatttgtactgtaagaggtttaagtatcgggttatttgtttgctcttccaaagagctctttttggtaaatattaagcaatttactattttatatcaatttgcttttatcgtagttgatgctgatgtaacagttataggttctgg

SEQ ID NO: 4763 - DNA, 170 bp, Homo sapiens
tgctgatttgtactgtaagaggtttaagtatcgggttatttgtttgctcttccaaagagctctttttggtaaatattaagcaatttactattttatatcaatttgcttttatcgtagttgatgctgatgtaacagttataggttctggtcctggaggatatgttgctgct

SEQ ID NO: 4764 - DNA, 170 bp, Homo sapiens
ggttatttgtttgctcttccaaagagctctttttggtaaatattaagcaatttactattttatatcaatttgcttttatcgtagttgatgctgatgtaacagttataggttctggtcctggaggatatgttgctgctattaaagctgcccagttaggcttcaaggtaagg

SEQ ID NO: 4765 - DNA, 170 bp, Homo sapiens
ccaaagagctctttttggtaaatattaagcaatttactattttatatcaatttgcttttatcgtagttgatgctgatgtaacagttataggttctggtcctggaggatatgttgctgctattaaagctgcccagttaggcttcaaggtaaggtttgaactcaaactaagt

SEQ ID NO: 4766 - DNA, 170 bp, Homo sapiens
agcaatttactattttatatcaatttgcttttatcgtagttgatgctgatgtaacagttataggttctggtcctggaggatatgttgctgctattaaagctgcccagttaggcttcaaggtaaggtttgaactcaaactaagtattgatttattttaatttgggaagggt

SEQ ID NO: 4767 - DNA, 170 bp, Homo sapiens
gcttttatcgtagttgatgctgatgtaacagttataggttctggtcctggaggatatgttgctgctattaaagctgcccagttaggcttcaaggtaaggtttgaactcaaactaagtattgatttattttaatttgggaagggttgatcatatttataaagtactttgca

SEQ ID NO: 4768 - DNA, 170 bp, Homo sapiens
gtaacagttataggttctggtcctggaggatatgttgctgctattaaagctgcccagttaggcttcaaggtaaggtttgaactcaaactaagtattgatttattttaatttgggaagggttgatcatatttataaagtactttgcaggcaaaaacatggtaaatacttcc

SEQ ID NO: 4769 - DNA, 170 bp, Homo sapiens
aggatatgttgctgctattaaagctgcccagttaggcttcaaggtaaggtttgaactcaaactaagtattgatttattttaatttgggaagggttgatcatatttataaagtactttgcaggcaaaaacatggtaaatacttccttaactctataaattacttgtaagcc

SEQ ID NO: 4770 - DNA, 170 bp, Homo sapiens
tgataaattataaaggactatatattttagtctgtgaaaacatagcccgaatagcttgttttgtagaagaattaagacatatatttggaattttagtgatctgaaacattgaggttatgtgcagttaaataatgttttctttggttgtagacagtctgcattgagaaaaa

SEQ ID NO: 4771 - DNA, 170 bp, Homo sapiens
tttagtctgtgaaaacatagcccgaatagcttgttttgtagaagaattaagacatatatttggaattttagtgatctgaaacattgaggttatgtgcagttaaataatgttttctttggttgtagacagtctgcattgagaaaaatgaaacacttggtggaacatgcttg

SEQ ID NO: 4772 - DNA, 170 bp, Homo sapiens
agcttgttttgtagaagaattaagacatatatttggaattttagtgatctgaaacattgaggttatgtgcagttaaataatgttttctttggttgtagacagtctgcattgagaaaaatgaaacacttggtggaacatgcttgaatgttggttgtattccttctaaggtg

SEQ ID NO: 4773 - DNA, 170 bp, Homo sapiens
agacatatatttggaattttagtgatctgaaacattgaggttatgtgcagttaaataatgttttctttggttgtagacagtctgcattgagaaaaatgaaacacttggtggaacatgcttgaatgttggttgtattccttctaaggtgagcatgtgttttgtacagcaca

SEQ ID NO: 4774 - DNA, 170 bp, Homo sapiens
tgaaacattgaggttatgtgcagttaaataatgttttctttggttgtagacagtctgcattgagaaaaatgaaacacttggtggaacatgcttgaatgttggttgtattccttctaaggtgagcatgtgttttgtacagcacagagattgtttttggctagcaaccaact

SEQ ID NO: 4775 - DNA, 170 bp, Homo sapiens
gttaaataatgttttctttggttgtagacagtctgcattgagaaaaatgaaacacttggtggaacatgcttgaatgttggttgtattccttctaaggtgagcatgtgttttgtacagcacagagattgtttttggctagcaaccaactagaaggatggattgagactaga

SEQ ID NO: 4776 - DNA, 170 bp, Homo sapiens
acagtctgcattgagaaaaatgaaacacttggtggaacatgcttgaatgttggttgtattccttctaaggtgagcatgtgttttgtacagcacagagattgtttttggctagcaaccaactagaaggatggattgagactagattagacaaatacacttgttaaaaaaca

SEQ ID NO: 4777 - DNA, 170 bp, Homo sapiens
acttggtggaacatgcttgaatgttggttgtattccttctaaggtgagcatgtgttttgtacagcacagagattgtttttggctagcaaccaactagaaggatggattgagactagattagacaaatacacttgttaaaaaacaatccaagttgtggcacatttcacaca

SEQ ID NO: 4778 - DNA, 170 bp, Homo sapiens
gcgccattgcactccagcttgggcaataagaacgaaactccgtctcaaaaaatgaaaagaaagactatcatttcataagtgctttttgattatttgaagtctgtttatgaatatttgataatttgatctttttaatttcctttaggctttattgaacaactctcattatt

SEQ ID NO: 4779 - DNA, 170 bp, Homo sapiens
ttgggcaataagaacgaaactccgtctcaaaaaatgaaaagaaagactatcatttcataagtgctttttgattatttgaagtctgtttatgaatatttgataatttgatctttttaatttcctttaggctttattgaacaactctcattattaccatatggcccatggaa

SEQ ID NO: 4780 - DNA, 170 bp, Homo sapiens
aaaaatgaaaagaaagactatcatttcataagtgctttttgattatttgaagtctgtttatgaatatttgataatttgatctttttaatttcctttaggctttattgaacaactctcattattaccatatggcccatggaaaagattttgcatctagaggaattgaaagt

SEQ ID NO: 4781 - DNA, 170 bp, Homo sapiens
ttcataagtgctttttgattatttgaagtctgtttatgaatatttgataatttgatctttttaatttcctttaggctttattgaacaactctcattattaccatatggcccatggaaaagattttgcatctagaggaattgaaagtaagtatacttttcatgcttaatga

SEQ ID NO: 4782 - DNA, 170 bp, Homo sapiens
gaagtctgtttatgaatatttgataatttgatctttttaatttcctttaggctttattgaacaactctcattattaccatatggcccatggaaaagattttgcatctagaggaattgaaagtaagtatacttttcatgcttaatgatattaccagactgcttgacttggc

SEQ ID NO: 4783 - DNA, 170 bp, Homo sapiens
tgatctttttaatttcctttaggctttattgaacaactctcattattaccatatggcccatggaaaagattttgcatctagaggaattgaaagtaagtatacttttcatgcttaatgatattaccagactgcttgacttggctcttctgtctaaagacttaaatgtgtct

SEQ ID NO: 4784 - DNA, 170 bp, Homo sapiens
gctttattgaacaactctcattattaccatatggcccatggaaaagattttgcatctagaggaattgaaagtaagtatacttttcatgcttaatgatattaccagactgcttgacttggctcttctgtctaaagacttaaatgtgtctaacgtacgcataatagatgttt

SEQ ID NO: 4785 - DNA, 170 bp, Homo sapiens
tggcccatggaaaagattttgcatctagaggaattgaaagtaagtatacttttcatgcttaatgatattaccagactgcttgacttggctcttctgtctaaagacttaaatgtgtctaacgtacgcataatagatgtttagtgaaggaagagtaaaataaataatctaaa

SEQ ID NO: 4786 - DNA, 170 bp, Homo sapiens
ttataagttattacattttgaaactttaatactgccttttataagcattaggttgaaattttccagttggtgagtgaaaaacactgcatattgcttcaagaatttagctaagaactaaagattaattgaacaaattacagtgtccgaagttcgcttgaatttagacaaga

SEQ ID NO: 4787 - DNA, 170 bp, Homo sapiens
ttaatactgccttttataagcattaggttgaaattttccagttggtgagtgaaaaacactgcatattgcttcaagaatttagctaagaactaaagattaattgaacaaattacagtgtccgaagttcgcttgaatttagacaagatgatggagcagaagagtactgcagt

SEQ ID NO: 4788 - DNA, 170 bp, Homo sapiens
ggttgaaattttccagttggtgagtgaaaaacactgcatattgcttcaagaatttagctaagaactaaagattaattgaacaaattacagtgtccgaagttcgcttgaatttagacaagatgatggagcagaagagtactgcagtaaaagctttaacaggtggaattgcc

SEQ ID NO: 4789 - DNA, 170 bp, Homo sapiens
aaacactgcatattgcttcaagaatttagctaagaactaaagattaattgaacaaattacagtgtccgaagttcgcttgaatttagacaagatgatggagcagaagagtactgcagtaaaagctttaacaggtggaattgcccacttattcaaacagaataaggtcagtg

SEQ ID NO: 4790 - DNA, 170 bp, Homo sapiens
ttagctaagaactaaagattaattgaacaaattacagtgtccgaagttcgcttgaatttagacaagatgatggagcagaagagtactgcagtaaaagctttaacaggtggaattgcccacttattcaaacagaataaggtcagtgtttaatattcagatttctgctttac

SEQ ID NO: 4791 - DNA, 170 bp, Homo sapiens
gaacaaattacagtgtccgaagttcgcttgaatttagacaagatgatggagcagaagagtactgcagtaaaagctttaacaggtggaattgcccacttattcaaacagaataaggtcagtgtttaatattcagatttctgctttactttgaatacaaattaaactttgca

SEQ ID NO: 4792 - DNA, 170 bp, Homo sapiens
gcttgaatttagacaagatgatggagcagaagagtactgcagtaaaagctttaacaggtggaattgcccacttattcaaacagaataaggtcagtgtttaatattcagatttctgctttactttgaatacaaattaaactttgcattatagagtgatgatatttgaactt

SEQ ID NO: 4793 - DNA, 170 bp, Homo sapiens
agcagaagagtactgcagtaaaagctttaacaggtggaattgcccacttattcaaacagaataaggtcagtgtttaatattcagatttctgctttactttgaatacaaattaaactttgcattatagagtgatgatatttgaacttggttacaggggaatatttatttaa

SEQ ID NO: 4794 - DNA, 170 bp, Homo sapiens
acaggtggaattgcccacttattcaaacagaataaggtcagtgtttaatattcagatttctgctttactttgaatacaaattaaactttgcattatagagtgatgatatttgaacttggttacaggggaatatttatttaatttaaaatagcttgctaacctgaaataga

SEQ ID NO: 4795 - DNA, 170 bp, Homo sapiens
tttgctgcaccatggtgtagcattactaagtaaggaagcattttgttttagataaattatttacagagtaatttttcctttgaatgatttatcaaacaaattactttaaactttgtgaatttataaagattattttgtaaaggttgttcatgtcaatggatatggaaaga

SEQ ID NO: 4796 - DNA, 170 bp, Homo sapiens
ttactaagtaaggaagcattttgttttagataaattatttacagagtaatttttcctttgaatgatttatcaaacaaattactttaaactttgtgaatttataaagattattttgtaaaggttgttcatgtcaatggatatggaaagataactggcaaaaatcaagtcac

SEQ ID NO: 4797 - DNA, 170 bp, Homo sapiens
gccacgggttcagaagttactccttttcctggaatcacggtatttatgcttcataatttacaaccattacaacttttctttagaaatacgttttataagttatttatgctatttgtgaactttgagagatttctgactgaaatactatattttgatggtcattcagcttt

SEQ ID NO: 4798 - DNA, 170 bp, Homo sapiens
tgttttagataaattatttacagagtaatttttcctttgaatgatttatcaaacaaattactttaaactttgtgaatttataaagattattttgtaaaggttgttcatgtcaatggatatggaaagataactggcaaaaatcaagtcactgctacgaaagctgatggcgg

SEQ ID NO: 4799 - DNA, 170 bp, Homo sapiens
tttcctttgaatgatttatcaaacaaattactttaaactttgtgaatttataaagattattttgtaaaggttgttcatgtcaatggatatggaaagataactggcaaaaatcaagtcactgctacgaaagctgatggcggcactcaggttattgatacaaagaacattct

SEQ ID NO: 4800 - DNA, 170 bp, Homo sapiens
caaacaaattactttaaactttgtgaatttataaagattattttgtaaaggttgttcatgtcaatggatatggaaagataactggcaaaaatcaagtcactgctacgaaagctgatggcggcactcaggttattgatacaaagaacattcttatagccacgggttcagaa

SEQ ID NO: 4801 - DNA, 170 bp, Homo sapiens
tttataaagattattttgtaaaggttgttcatgtcaatggatatggaaagataactggcaaaaatcaagtcactgctacgaaagctgatggcggcactcaggttattgatacaaagaacattcttatagccacgggttcagaagttactccttttcctggaatcacggta

SEQ ID NO: 4802 - DNA, 170 bp, Homo sapiens
catgtcaatggatatggaaagataactggcaaaaatcaagtcactgctacgaaagctgatggcggcactcaggttattgatacaaagaacattcttatagccacgggttcagaagttactccttttcctggaatcacggtatttatgcttcataatttacaaccattaca

SEQ ID NO: 4803 - DNA, 170 bp, Homo sapiens
actggcaaaaatcaagtcactgctacgaaagctgatggcggcactcaggttattgatacaaagaacattcttatagccacgggttcagaagttactccttttcctggaatcacggtatttatgcttcataatttacaaccattacaacttttctttagaaatacgtttta

SEQ ID NO: 4804 - DNA, 170 bp, Homo sapiens
agctgatggcggcactcaggttattgatacaaagaacattcttatagccacgggttcagaagttactccttttcctggaatcacggtatttatgcttcataatttacaaccattacaacttttctttagaaatacgttttataagttatttatgctatttgtgaactttg

SEQ ID NO: 4805 - DNA, 170 bp, Homo sapiens
ggttattgatacaaagaacattcttatagccacgggttcagaagttactccttttcctggaatcacggtatttatgcttcataatttacaaccattacaacttttctttagaaatacgttttataagttatttatgctatttgtgaactttgagagatttctgactgaaa

SEQ ID NO: 4806 - DNA, 170 bp, Homo sapiens
cagtacagatgcaaccatcaatttttttcctgaatattttcaattaatggttggttaaatctgcaaatttggaacccatggatatggagggtcgactgtactaggttttttcaaattattttgattatatcttttgtttttcttacagatagatgaagatacaatagtgt

SEQ ID NO: 4807 - DNA, 170 bp, Homo sapiens
tttttttcctgaatattttcaattaatggttggttaaatctgcaaatttggaacccatggatatggagggtcgactgtactaggttttttcaaattattttgattatatcttttgtttttcttacagatagatgaagatacaatagtgtcatctacaggtgctttatctt

SEQ ID NO: 4808 - DNA, 170 bp, Homo sapiens
ggttggttaaatctgcaaatttggaacccatggatatggagggtcgactgtactaggttttttcaaattattttgattatatcttttgtttttcttacagatagatgaagatacaatagtgtcatctacaggtgctttatctttaaaaaaagttccagaaaagatggttg

SEQ ID NO: 4809 - DNA, 170 bp, Homo sapiens
ggaacccatggatatggagggtcgactgtactaggttttttcaaattattttgattatatcttttgtttttcttacagatagatgaagatacaatagtgtcatctacaggtgctttatctttaaaaaaagttccagaaaagatggttgttattggtgcaggagtaatagg

SEQ ID NO: 4810 - DNA, 170 bp, Homo sapiens
tgtactaggttttttcaaattattttgattatatcttttgtttttcttacagatagatgaagatacaatagtgtcatctacaggtgctttatctttaaaaaaagttccagaaaagatggttgttattggtgcaggagtaataggtgtagaattggtaagtgttgtctttc

SEQ ID NO: 4811 - DNA, 170 bp, Homo sapiens
tgattatatcttttgtttttcttacagatagatgaagatacaatagtgtcatctacaggtgctttatctttaaaaaaagttccagaaaagatggttgttattggtgcaggagtaataggtgtagaattggtaagtgttgtctttctgcctcttattacctccttggagtt

SEQ ID NO: 4812 - DNA, 170 bp, Homo sapiens
cagatagatgaagatacaatagtgtcatctacaggtgctttatctttaaaaaaagttccagaaaagatggttgttattggtgcaggagtaataggtgtagaattggtaagtgttgtctttctgcctcttattacctccttggagttggaagggacttaaaggtccccttt

SEQ ID NO: 4813 - DNA, 170 bp, Homo sapiens
ctacaggtgctttatctttaaaaaaagttccagaaaagatggttgttattggtgcaggagtaataggtgtagaattggtaagtgttgtctttctgcctcttattacctccttggagttggaagggacttaaaggtcccctttttgattttttgtataacattacaggctg

SEQ ID NO: 4814 - DNA, 170 bp, Homo sapiens
gttccagaaaagatggttgttattggtgcaggagtaataggtgtagaattggtaagtgttgtctttctgcctcttattacctccttggagttggaagggacttaaaggtcccctttttgattttttgtataacattacaggctgatcagcattgagttttgcttaaacac

SEQ ID NO: 4815 - DNA, 170 bp, Homo sapiens
gcaggagtaataggtgtagaattggtaagtgttgtctttctgcctcttattacctccttggagttggaagggacttaaaggtcccctttttgattttttgtataacattacaggctgatcagcattgagttttgcttaaacacttctagtaataaagagtttacttttgt

SEQ ID NO: 4816 - DNA, 170 bp, Homo sapiens
tttaaacctcggagcttctcataggaacatactagcgaaagaagaaaatgttttacaataaattattaagatgatttcgtaaacatttgctatagaaacttttatgattattgggtttttttaatttatttgcagggttcagtttggcaaagacttggtgcagatgtgac

SEQ ID NO: 4817 - DNA, 170 bp, Homo sapiens
acatactagcgaaagaagaaaatgttttacaataaattattaagatgatttcgtaaacatttgctatagaaacttttatgattattgggtttttttaatttatttgcagggttcagtttggcaaagacttggtgcagatgtgacagcagttgaatttttaggtcatgtag

SEQ ID NO: 4818 - DNA, 170 bp, Homo sapiens
aacaggggtttaaatttaaattgaatacaaaggttactggtgctaccaagaagtcagatggaaaaattgatgtttcgtaagtatacatcatttgtttttgatgtatcatccctgtctctttaagcaaaacactcaagtttcaaaatcagtttagcaaatatagggttttt

SEQ ID NO: 4819 - DNA, 170 bp, Homo sapiens
acaaaggttactggtgctaccaagaagtcagatggaaaaattgatgtttcgtaagtatacatcatttgtttttgatgtatcatccctgtctctttaagcaaaacactcaagtttcaaaatcagtttagcaaatatagggttttttctaacttaaggtcattttattactt

SEQ ID NO: 4820 - DNA, 170 bp, Homo sapiens
agaagtcagatggaaaaattgatgtttcgtaagtatacatcatttgtttttgatgtatcatccctgtctctttaagcaaaacactcaagtttcaaaatcagtttagcaaatatagggttttttctaacttaaggtcattttattacttaatataactcagttgcttatca

SEQ ID NO: 4821 - DNA, 170 bp, Homo sapiens
tgttttacaataaattattaagatgatttcgtaaacatttgctatagaaacttttatgattattgggtttttttaatttatttgcagggttcagtttggcaaagacttggtgcagatgtgacagcagttgaatttttaggtcatgtaggtggagttggaattgatatgga

SEQ ID NO: 4822 - DNA, 170 bp, Homo sapiens
ttcgtaaacatttgctatagaaacttttatgattattgggtttttttaatttatttgcagggttcagtttggcaaagacttggtgcagatgtgacagcagttgaatttttaggtcatgtaggtggagttggaattgatatggagatatctaaaaactttcaacgcatcct

SEQ ID NO: 4823 - DNA, 170 bp, Homo sapiens
acttttatgattattgggtttttttaatttatttgcagggttcagtttggcaaagacttggtgcagatgtgacagcagttgaatttttaggtcatgtaggtggagttggaattgatatggagatatctaaaaactttcaacgcatccttcaaaaacaggggtttaaattt

SEQ ID NO: 4824 - DNA, 170 bp, Homo sapiens
tttatttgcagggttcagtttggcaaagacttggtgcagatgtgacagcagttgaatttttaggtcatgtaggtggagttggaattgatatggagatatctaaaaactttcaacgcatccttcaaaaacaggggtttaaatttaaattgaatacaaaggttactggtgct

SEQ ID NO: 4825 - DNA, 170 bp, Homo sapiens
agacttggtgcagatgtgacagcagttgaatttttaggtcatgtaggtggagttggaattgatatggagatatctaaaaactttcaacgcatccttcaaaaacaggggtttaaatttaaattgaatacaaaggttactggtgctaccaagaagtcagatggaaaaattga

SEQ ID NO: 4826 - DNA, 170 bp, Homo sapiens
ttgaatttttaggtcatgtaggtggagttggaattgatatggagatatctaaaaactttcaacgcatccttcaaaaacaggggtttaaatttaaattgaatacaaaggttactggtgctaccaagaagtcagatggaaaaattgatgtttcgtaagtatacatcatttgt

SEQ ID NO: 4827 - DNA, 170 bp, Homo sapiens
ggagttggaattgatatggagatatctaaaaactttcaacgcatccttcaaaaacaggggtttaaatttaaattgaatacaaaggttactggtgctaccaagaagtcagatggaaaaattgatgtttcgtaagtatacatcatttgtttttgatgtatcatccctgtctc

SEQ ID NO: 4828 - DNA, 170 bp, Homo sapiens
aactttcaacgcatccttcaaaaacaggggtttaaatttaaattgaatacaaaggttactggtgctaccaagaagtcagatggaaaaattgatgtttcgtaagtatacatcatttgtttttgatgtatcatccctgtctctttaagcaaaacactcaagtttcaaaatca

SEQ ID NO: 4829 - DNA, 170 bp, Homo sapiens
ggagttcctaaggaagatgtatgaagccttgaaagagatggtaagtagtggaccagaataatgaaattattttctgacttcagggactctaccagatttcaccaagacagaatgccacccagaatcgggacttgtggtattgactgaagtgccgatggattaggaagaca

SEQ ID NO: 4830 - DNA, 170 bp, Homo sapiens
tgtcttcacgtggctcagttccaggagttcctaaggaagatgtatgaagccttgaaagagatggtaagtagtggaccagaataatgaaattattttctgacttcagggactctaccagatttcaccaagacagaatgccacccagaatcgggacttgtggtattgactga

SEQ ID NO: 4831 - DNA, 170 bp, Homo sapiens
aagagccttttagaaatgcttctatttgttccctttcttacagatttaatgtgtgccgaccatttccttcagtgctggacaggctgctgtgaagggacatcaccttttcgctttttccaagatggctcaagattcagtagatctttcttgtgattatcagttttggatgc

SEQ ID NO: 4832 - DNA, 170 bp, Homo sapiens
cactttggaaacccagcaagacacctgtcttcacgtggctcagttccaggagttcctaaggaagatgtatgaagccttgaaagagatggtaagtagtggaccagaataatgaaattattttctgacttcagggactctaccagatttcaccaagacagaatgccacccag

SEQ ID NO: 4833 - DNA, 170 bp, Homo sapiens
aagctttctgtatgggatcaggcttccactttggaaacccagcaagacacctgtcttcacgtggctcagttccaggagttcctaaggaagatgtatgaagccttgaaagagatggtaagtagtggaccagaataatgaaattattttctgacttcagggactctaccaga

SEQ ID NO: 4834 - DNA, 170 bp, Homo sapiens
tgtgattatcagttttggatgcagaagctttctgtatgggatcaggcttccactttggaaacccagcaagacacctgtcttcacgtggctcagttccaggagttcctaaggaagatgtatgaagccttgaaagagatggtaagtagtggaccagaataatgaaattattt

SEQ ID NO: 4835 - DNA, 170 bp, Homo sapiens
tggctcaagattcagtagatctttcttgtgattatcagttttggatgcagaagctttctgtatgggatcaggcttccactttggaaacccagcaagacacctgtcttcacgtggctcagttccaggagttcctaaggaagatgtatgaagccttgaaagagatggtaagt

SEQ ID NO: 4836 - DNA, 170 bp, Homo sapiens
tcaccttttcgctttttccaagatggctcaagattcagtagatctttcttgtgattatcagttttggatgcagaagctttctgtatgggatcaggcttccactttggaaacccagcaagacacctgtcttcacgtggctcagttccaggagttcctaaggaagatgtatg

SEQ ID NO: 4837 - DNA, 170 bp, Homo sapiens
tggacaggctgctgtgaagggacatcaccttttcgctttttccaagatggctcaagattcagtagatctttcttgtgattatcagttttggatgcagaagctttctgtatgggatcaggcttccactttggaaacccagcaagacacctgtcttcacgtggctcagttcc

SEQ ID NO: 4838 - DNA, 170 bp, Homo sapiens
tgtgtgccgaccatttccttcagtgctggacaggctgctgtgaagggacatcaccttttcgctttttccaagatggctcaagattcagtagatctttcttgtgattatcagttttggatgcagaagctttctgtatgggatcaggcttccactttggaaacccagcaaga

SEQ ID NO: 4839 - DNA, 170 bp, Homo sapiens
tttgttccctttcttacagatttaatgtgtgccgaccatttccttcagtgctggacaggctgctgtgaagggacatcaccttttcgctttttccaagatggctcaagattcagtagatctttcttgtgattatcagttttggatgcagaagctttctgtatgggatcagg

SEQ ID NO: 4840 - DNA, 170 bp, Homo sapiens
ctccatctcttgccatggtgctgctgcaagaccctcaaggtgagttagggttgactttgcccacatcagaatgatttcctgggaagagcattgtcaaattatgacctcctcatcaggcccttatctacagcatgagggagacagaactggttatttctaagatcccttta

SEQ ID NO: 4841 - DNA, 170 bp, Homo sapiens
gacctactttccttacacttctccatctcttgccatggtgctgctgcaagaccctcaaggtgagttagggttgactttgcccacatcagaatgatttcctgggaagagcattgtcaaattatgacctcctcatcaggcccttatctacagcatgagggagacagaactgg

SEQ ID NO: 4842 - DNA, 170 bp, Homo sapiens
gcagctgcggtttgcactcaagacctactttccttacacttctccatctcttgccatggtgctgctgcaagaccctcaaggtgagttagggttgactttgcccacatcagaatgatttcctgggaagagcattgtcaaattatgacctcctcatcaggcccttatctaca

SEQ ID NO: 4843 - DNA, 170 bp, Homo sapiens
tgttcatgctctttggattttccatcctgtggcagctgcggtttgcactcaagacctactttccttacacttctccatctcttgccatggtgctgctgcaagaccctcaaggtgagttagggttgactttgcccacatcagaatgatttcctgggaagagcattgtcaaa

SEQ ID NO: 4844 - DNA, 170 bp, Homo sapiens
cctgaccccgtttcaatcttaatgttcatgctctttggattttccatcctgtggcagctgcggtttgcactcaagacctactttccttacacttctccatctcttgccatggtgctgctgcaagaccctcaaggtgagttagggttgactttgcccacatcagaatgatt

SEQ ID NO: 4845 - DNA, 170 bp, Homo sapiens
gcagaggactcagagttttgtattttcctgaccccgtttcaatcttaatgttcatgctctttggattttccatcctgtggcagctgcggtttgcactcaagacctactttccttacacttctccatctcttgccatggtgctgctgcaagaccctcaaggtgagttaggg

SEQ ID NO: 4846 - DNA, 170 bp, Homo sapiens
tgttagtactggtgggtcttttttgggcagaggactcagagttttgtattttcctgaccccgtttcaatcttaatgttcatgctctttggattttccatcctgtggcagctgcggtttgcactcaagacctactttccttacacttctccatctcttgccatggtgctgc

SEQ ID NO: 4847 - DNA, 170 bp, Homo sapiens
tgtttaagaaagtgttctgaccatgttagtactggtgggtcttttttgggcagaggactcagagttttgtattttcctgaccccgtttcaatcttaatgttcatgctctttggattttccatcctgtggcagctgcggtttgcactcaagacctactttccttacacttc

SEQ ID NO: 4848 - DNA, 170 bp, Homo sapiens
cagttgaagaccagactcatgggtgagcaaacactgaccactcccaaatctacttcacacatggtttccctagatcctcatctgccctttgagcagggctgacagaggaaggcattactggtctgggaccatcaccaaacaggtgagcaccatggtgaagtgagaagtgg

SEQ ID NO: 4849 - DNA, 170 bp, Homo sapiens
tgaagcatatttctgaactgctcagagaagcagttgaagaccagactcatgggtgagcaaacactgaccactcccaaatctacttcacacatggtttccctagatcctcatctgccctttgagcagggctgacagaggaaggcattactggtctgggaccatcaccaaac

SEQ ID NO: 4850 - DNA, 170 bp, Homo sapiens
gacactggctccagacactgaagcatatttctgaactgctcagagaagcagttgaagaccagactcatgggtgagcaaacactgaccactcccaaatctacttcacacatggtttccctagatcctcatctgccctttgagcagggctgacagaggaaggcattactggt

SEQ ID NO: 4851 - DNA, 170 bp, Homo sapiens
tctctccacccgcagatatccctcggggacactggctccagacactgaagcatatttctgaactgctcagagaagcagttgaagaccagactcatgggtgagcaaacactgaccactcccaaatctacttcacacatggtttccctagatcctcatctgccctttgagca

SEQ ID NO: 4852 - DNA, 170 bp, Homo sapiens
tcctcagttgccctctgacgtatctctctccacccgcagatatccctcggggacactggctccagacactgaagcatatttctgaactgctcagagaagcagttgaagaccagactcatgggtgagcaaacactgaccactcccaaatctacttcacacatggtttccct

SEQ ID NO: 4853 - DNA, 170 bp, Homo sapiens
ggtggttcctcatgggcttgacatttcctcagttgccctctgacgtatctctctccacccgcagatatccctcggggacactggctccagacactgaagcatatttctgaactgctcagagaagcagttgaagaccagactcatgggtgagcaaacactgaccactccca

SEQ ID NO: 4854 - DNA, 170 bp, Homo sapiens
ccaaagactcttcaggtcatccctgcaggtggttcctcatgggcttgacatttcctcagttgccctctgacgtatctctctccacccgcagatatccctcggggacactggctccagacactgaagcatatttctgaactgctcagagaagcagttgaagaccagactca

SEQ ID NO: 4855 - DNA, 170 bp, Homo sapiens
accagaagtaaagggcgtctcccaaagactcttcaggtcatccctgcaggtggttcctcatgggcttgacatttcctcagttgccctctgacgtatctctctccacccgcagatatccctcggggacactggctccagacactgaagcatatttctgaactgctcagaga

SEQ ID NO: 4856 - DNA, 170 bp, Homo sapiens
aagcatgagaacagtattgggttccgtgaaccagaagtaaagggcgtctcccaaagactcttcaggtcatccctgcaggtggttcctcatgggcttgacatttcctcagttgccctctgacgtatctctctccacccgcagatatccctcggggacactggctccagaca

SEQ ID NO: 4857 - DNA, 170 bp, Homo sapiens
ggcagcagagagcacagactatggtgggtagcaggccccactgcatgtgtttggggtgggctctggggggctgagaggagcttgcagagaggggctctgttgtgggcttggcttccatgacacctgagctctgcccacagatggcatatgtcatggcaacctgcaggcat

SEQ ID NO: 4858 - DNA, 170 bp, Homo sapiens
tctactacggcccccgtgatgggaggcagcagagagcacagactatggtgggtagcaggccccactgcatgtgtttggggtgggctctggggggctgagaggagcttgcagagaggggctctgttgtgggcttggcttccatgacacctgagctctgcccacagatggca

SEQ ID NO: 4859 - DNA, 170 bp, Homo sapiens
atttaagccaaccgttggcaaacgttaaagttgctttaaaaacccaaaggaagaagaatttaggttgtcaactgccatgtgttctgcctctgttccaggtcctgcggaggtccctttgagagctggttcctgttcattcacttcggaggatgggctgagatggtggcaga

SEQ ID NO: 4860 - DNA, 170 bp, Homo sapiens
ggttgcacttcagtggataagtacaatttaagccaaccgttggcaaacgttaaagttgctttaaaaacccaaaggaagaagaatttaggttgtcaactgccatgtgttctgcctctgttccaggtcctgcggaggtccctttgagagctggttcctgttcattcacttcg

SEQ ID NO: 4861 - DNA, 170 bp, Homo sapiens
ttctgaatctaaattgtattccttgcaggttgcacttcagtggataagtacaatttaagccaaccgttggcaaacgttaaagttgctttaaaaacccaaaggaagaagaatttaggttgtcaactgccatgtgttctgcctctgttccaggtcctgcggaggtccctttg

SEQ ID NO: 4862 - DNA, 170 bp, Homo sapiens
ggccctgctgtggctcttggccttctactacggcccccgtgatgggaggcagcagagagcacagactatggtgggtagcaggccccactgcatgtgtttggggtgggctctggggggctgagaggagcttgcagagaggggctctgttgtgggcttggcttccatgacac

SEQ ID NO: 4863 - DNA, 170 bp, Homo sapiens
actgatgtcggcagccgaaccccccacggccctgctgtggctcttggccttctactacggcccccgtgatgggaggcagcagagagcacagactatggtgggtagcaggccccactgcatgtgtttggggtgggctctggggggctgagaggagcttgcagagaggggct

SEQ ID NO: 4864 - DNA, 170 bp, Homo sapiens
atgggctgagatggtggcagagcaattactgatgtcggcagccgaaccccccacggccctgctgtggctcttggccttctactacggcccccgtgatgggaggcagcagagagcacagactatggtgggtagcaggccccactgcatgtgtttggggtgggctctggggg

SEQ ID NO: 4865 - DNA, 170 bp, Homo sapiens
tggttcctgttcattcacttcggaggatgggctgagatggtggcagagcaattactgatgtcggcagccgaaccccccacggccctgctgtggctcttggccttctactacggcccccgtgatgggaggcagcagagagcacagactatggtgggtagcaggccccactg

SEQ ID NO: 4866 - DNA, 170 bp, Homo sapiens
cctgcggaggtccctttgagagctggttcctgttcattcacttcggaggatgggctgagatggtggcagagcaattactgatgtcggcagccgaaccccccacggccctgctgtggctcttggccttctactacggcccccgtgatgggaggcagcagagagcacagact

SEQ ID NO: 4867 - DNA, 170 bp, Homo sapiens
ccatgtgttctgcctctgttccaggtcctgcggaggtccctttgagagctggttcctgttcattcacttcggaggatgggctgagatggtggcagagcaattactgatgtcggcagccgaaccccccacggccctgctgtggctcttggccttctactacggcccccgtg

SEQ ID NO: 4868 - DNA, 170 bp, Homo sapiens
aggaagaagaatttaggttgtcaactgccatgtgttctgcctctgttccaggtcctgcggaggtccctttgagagctggttcctgttcattcacttcggaggatgggctgagatggtggcagagcaattactgatgtcggcagccgaaccccccacggccctgctgtggc

SEQ ID NO: 4869 - DNA, 170 bp, Homo sapiens
gttaaagttgctttaaaaacccaaaggaagaagaatttaggttgtcaactgccatgtgttctgcctctgttccaggtcctgcggaggtccctttgagagctggttcctgttcattcacttcggaggatgggctgagatggtggcagagcaattactgatgtcggcagccg

SEQ ID NO: 4870 - DNA, 170 bp, Homo sapiens
cacacgatcgcctgggatgtcatcaccctggtaagtctccctgtggtccagcatcctagtactcatttctgctccaggcgagaggtgggttacctgtccgagggtctggcctctgcacagtgtgtgtaccaggatgctgcccagcacagataaatggtcaaggaggttga

SEQ ID NO: 4871 - DNA, 170 bp, Homo sapiens
caacttcctgctctgggctcctggaggccacacgatcgcctgggatgtcatcaccctggtaagtctccctgtggtccagcatcctagtactcatttctgctccaggcgagaggtgggttacctgtccgagggtctggcctctgcacagtgtgtgtaccaggatgctgccc

SEQ ID NO: 4872 - DNA, 170 bp, Homo sapiens
tgtttcaaagcaaataaataaatcctagaagtatgtctgtcctgcctcttcctaacctctcccctgtgaaatactattgcccaggtccaggtgaaggccgtgctgggccacctcctggcaatgtccagaagcagcagcctctcagcccaggacctgcagacggtagcagg

SEQ ID NO: 4873 - DNA, 170 bp, Homo sapiens
gtgcttacccgtttctgggggttgtttcaaagcaaataaataaatcctagaagtatgtctgtcctgcctcttcctaacctctcccctgtgaaatactattgcccaggtccaggtgaaggccgtgctgggccacctcctggcaatgtccagaagcagcagcctctcagccc

SEQ ID NO: 4874 - DNA, 170 bp, Homo sapiens
cctagctccctctctcaggggccagtgcttacccgtttctgggggttgtttcaaagcaaataaataaatcctagaagtatgtctgtcctgcctcttcctaacctctcccctgtgaaatactattgcccaggtccaggtgaaggccgtgctgggccacctcctggcaatgt

SEQ ID NO: 4875 - DNA, 170 bp, Homo sapiens
acaacagctgatcaggcaccttctcctcaacttcctgctctgggctcctggaggccacacgatcgcctgggatgtcatcaccctggtaagtctccctgtggtccagcatcctagtactcatttctgctccaggcgagaggtgggttacctgtccgagggtctggcctctg

SEQ ID NO: 4876 - DNA, 170 bp, Homo sapiens
cagacacagacctcagagctcctgcacaacagctgatcaggcaccttctcctcaacttcctgctctgggctcctggaggccacacgatcgcctgggatgtcatcaccctggtaagtctccctgtggtccagcatcctagtactcatttctgctccaggcgagaggtgggt

SEQ ID NO: 4877 - DNA, 170 bp, Homo sapiens
gcagacggtagcaggacagggcacagacacagacctcagagctcctgcacaacagctgatcaggcaccttctcctcaacttcctgctctgggctcctggaggccacacgatcgcctgggatgtcatcaccctggtaagtctccctgtggtccagcatcctagtactcatt

SEQ ID NO: 4878 - DNA, 170 bp, Homo sapiens
agcagcctctcagcccaggacctgcagacggtagcaggacagggcacagacacagacctcagagctcctgcacaacagctgatcaggcaccttctcctcaacttcctgctctgggctcctggaggccacacgatcgcctgggatgtcatcaccctggtaagtctccctgt

SEQ ID NO: 4879 - DNA, 170 bp, Homo sapiens
ggccacctcctggcaatgtccagaagcagcagcctctcagcccaggacctgcagacggtagcaggacagggcacagacacagacctcagagctcctgcacaacagctgatcaggcaccttctcctcaacttcctgctctgggctcctggaggccacacgatcgcctggga

SEQ ID NO: 4880 - DNA, 170 bp, Homo sapiens
aggtccaggtgaaggccgtgctgggccacctcctggcaatgtccagaagcagcagcctctcagcccaggacctgcagacggtagcaggacagggcacagacacagacctcagagctcctgcacaacagctgatcaggcaccttctcctcaacttcctgctctgggctcct

SEQ ID NO: 4881 - DNA, 170 bp, Homo sapiens
acctctcccctgtgaaatactattgcccaggtccaggtgaaggccgtgctgggccacctcctggcaatgtccagaagcagcagcctctcagcccaggacctgcagacggtagcaggacagggcacagacacagacctcagagctcctgcacaacagctgatcaggcacct

SEQ ID NO: 4882 - DNA, 170 bp, Homo sapiens
gtatgtctgtcctgcctcttcctaacctctcccctgtgaaatactattgcccaggtccaggtgaaggccgtgctgggccacctcctggcaatgtccagaagcagcagcctctcagcccaggacctgcagacggtagcaggacagggcacagacacagacctcagagctcc

SEQ ID NO: 4883 - DNA, 170 bp, Homo sapiens
ccttaaagagctgcgaactcaagtctagaaggcacgcaggccgtgtgggtgcccggcgtgagggatcaggctcgccagggccacaggacaggtgatgacctgtggccacgcatttgtggagtaagtgccctcgctgggctgtgagaatgagctgtacacatcttgggaca

SEQ ID NO: 4884 - DNA, 170 bp, Homo sapiens
ctagatcagaaaaactggcccgagagctccttaaagagctgcgaactcaagtctagaaggcacgcaggccgtgtgggtgcccggcgtgagggatcaggctcgccagggccacaggacaggtgatgacctgtggccacgcatttgtggagtaagtgccctcgctgggctgt

SEQ ID NO: 4885 - DNA, 170 bp, Homo sapiens
actttggaactgatggaaatgctggatagggcttctttcagggactgggtggttatggtccgtccctggacaaaggacaaatctgtctggaaagtgttttaatttgccttctcttctgtcctgattgcagatggctcacactgctgagataactcacgagatcattggct

SEQ ID NO: 4886 - DNA, 170 bp, Homo sapiens
ggaatcgtcttggcattgaaagccctagatcagaaaaactggcccgagagctccttaaagagctgcgaactcaagtctagaaggcacgcaggccgtgtgggtgcccggcgtgagggatcaggctcgccagggccacaggacaggtgatgacctgtggccacgcatttgtg

SEQ ID NO: 4887 - DNA, 170 bp, Homo sapiens
tttcttgaccagaccttgtacagatggaatcgtcttggcattgaaagccctagatcagaaaaactggcccgagagctccttaaagagctgcgaactcaagtctagaaggcacgcaggccgtgtgggtgcccggcgtgagggatcaggctcgccagggccacaggacaggt

SEQ ID NO: 4888 - DNA, 170 bp, Homo sapiens
tgctgagataactcacgagatcattggctttcttgaccagaccttgtacagatggaatcgtcttggcattgaaagccctagatcagaaaaactggcccgagagctccttaaagagctgcgaactcaagtctagaaggcacgcaggccgtgtgggtgcccggcgtgaggga

SEQ ID NO: 4889 - DNA, 170 bp, Homo sapiens
cctgattgcagatggctcacactgctgagataactcacgagatcattggctttcttgaccagaccttgtacagatggaatcgtcttggcattgaaagccctagatcagaaaaactggcccgagagctccttaaagagctgcgaactcaagtctagaaggcacgcaggccg

SEQ ID NO: 4890 - DNA, 170 bp, Homo sapiens
tgttttaatttgccttctcttctgtcctgattgcagatggctcacactgctgagataactcacgagatcattggctttcttgaccagaccttgtacagatggaatcgtcttggcattgaaagccctagatcagaaaaactggcccgagagctccttaaagagctgcgaac

SEQ ID NO: 4891 - DNA, 170 bp, Homo sapiens
aaaggacaaatctgtctggaaagtgttttaatttgccttctcttctgtcctgattgcagatggctcacactgctgagataactcacgagatcattggctttcttgaccagaccttgtacagatggaatcgtcttggcattgaaagccctagatcagaaaaactggcccga

SEQ ID NO: 4892 - DNA, 170 bp, Homo sapiens
gtggttatggtccgtccctggacaaaggacaaatctgtctggaaagtgttttaatttgccttctcttctgtcctgattgcagatggctcacactgctgagataactcacgagatcattggctttcttgaccagaccttgtacagatggaatcgtcttggcattgaaagcc

SEQ ID NO: 4893 - DNA, 170 bp, Homo sapiens
ctggatagggcttctttcagggactgggtggttatggtccgtccctggacaaaggacaaatctgtctggaaagtgttttaatttgccttctcttctgtcctgattgcagatggctcacactgctgagataactcacgagatcattggctttcttgaccagaccttgtaca

SEQ ID NO: 4894 - DNA, 170 bp, Homo sapiens
gcttgttggaatccttttattttagcatatggtaagaatcaaaaacgtgtcctctcaaaatggctattttaatctttgcattgtttcacagaggcttacattatgaacctttctcctagttttttttttttaatggaacaacttatcaaatgtattcattgttctattac

SEQ ID NO: 4895 - DNA, 170 bp, Homo sapiens
ccacaattggtcaactgttggcaaaagcttgttggaatccttttattttagcatatggtaagaatcaaaaacgtgtcctctcaaaatggctattttaatctttgcattgtttcacagaggcttacattatgaacctttctcctagttttttttttttaatggaacaactt

SEQ ID NO: 4896 - DNA, 170 bp, Homo sapiens
ctaatacagtcattgaaagattccccacaattggtcaactgttggcaaaagcttgttggaatccttttattttagcatatggtaagaatcaaaaacgtgtcctctcaaaatggctattttaatctttgcattgtttcacagaggcttacattatgaacctttctcctagt

SEQ ID NO: 4897 - DNA, 170 bp, Homo sapiens
ccaaaatttatttttctttcacaggattctaatacagtcattgaaagattccccacaattggtcaactgttggcaaaagcttgttggaatccttttattttagcatatggtaagaatcaaaaacgtgtcctctcaaaatggctattttaatctttgcattgtttcacaga

SEQ ID NO: 4898 - DNA, 170 bp, Homo sapiens
agttgcataatgcctttactgaccaaaatttatttttctttcacaggattctaatacagtcattgaaagattccccacaattggtcaactgttggcaaaagcttgttggaatccttttattttagcatatggtaagaatcaaaaacgtgtcctctcaaaatggctatttt

SEQ ID NO: 4899 - DNA, 170 bp, Homo sapiens
ataatgtcagttcagtatttctaagttgcataatgcctttactgaccaaaatttatttttctttcacaggattctaatacagtcattgaaagattccccacaattggtcaactgttggcaaaagcttgttggaatccttttattttagcatatggtaagaatcaaaaacg

SEQ ID NO: 4900 - DNA, 170 bp, Homo sapiens
aacaagaagcattcacgttccctcaatctataatgtcagttcagtatttctaagttgcataatgcctttactgaccaaaatttatttttctttcacaggattctaatacagtcattgaaagattccccacaattggtcaactgttggcaaaagcttgttggaatcctttt

SEQ ID NO: 4901 - DNA, 170 bp, Homo sapiens
tgcttacttttaaaaatggtatactaaacaagaagcattcacgttccctcaatctataatgtcagttcagtatttctaagttgcataatgcctttactgaccaaaatttatttttctttcacaggattctaatacagtcattgaaagattccccacaattggtcaactgt

SEQ ID NO: 4902 - DNA, 170 bp, Homo sapiens
aagatcttctctaatccttttgtgcttacttttaaaaatggtatactaaacaagaagcattcacgttccctcaatctataatgtcagttcagtatttctaagttgcataatgcctttactgaccaaaatttatttttctttcacaggattctaatacagtcattgaaaga

SEQ ID NO: 4903 - DNA, 170 bp, Homo sapiens
tcaaaacttaactcctggatacaggtaagagagtaaatcttgctctgcacttctttgaattaaattgattatttaaaagtgctgcttaaaaaaattttggggtggggtggaatccagttctatgatgttttagaaactttttcaaacatacccttcactgttacattatc

SEQ ID NO: 4904 - DNA, 170 bp, Homo sapiens
ccacagaattctggacaatcaaaacttaactcctggatacaggtaagagagtaaatcttgctctgcacttctttgaattaaattgattatttaaaagtgctgcttaaaaaaattttggggtggggtggaatccagttctatgatgttttagaaactttttcaaacatacc

SEQ ID NO: 4905 - DNA, 170 bp, Homo sapiens
atggtgcttatgttgtctaattaacaaagaaccacagaattctggacaatcaaaacttaactcctggatacaggtaagagagtaaatcttgctctgcacttctttgaattaaattgattatttaaaagtgctgcttaaaaaaattttggggtggggtggaatccagttct

SEQ ID NO: 4906 - DNA, 170 bp, Homo sapiens
tgaaagccaaaaaattctaatatggtgcttatgttgtctaattaacaaagaaccacagaattctggacaatcaaaacttaactcctggatacaggtaagagagtaaatcttgctctgcacttctttgaattaaattgattatttaaaagtgctgcttaaaaaaattttgg

SEQ ID NO: 4907 - DNA, 170 bp, Homo sapiens
acttattaagttttcctttttgtagatgaaagccaaaaaattctaatatggtgcttatgttgtctaattaacaaagaaccacagaattctggacaatcaaaacttaactcctggatacaggtaagagagtaaatcttgctctgcacttctttgaattaaattgattattt

SEQ ID NO: 4908 - DNA, 170 bp, Homo sapiens
ttaatgattttttctgcttgataaaacttattaagttttcctttttgtagatgaaagccaaaaaattctaatatggtgcttatgttgtctaattaacaaagaaccacagaattctggacaatcaaaacttaactcctggatacaggtaagagagtaaatcttgctctgca

SEQ ID NO: 4909 - DNA, 170 bp, Homo sapiens
ataatgtttacagtgtttttatattaatgattttttctgcttgataaaacttattaagttttcctttttgtagatgaaagccaaaaaattctaatatggtgcttatgttgtctaattaacaaagaaccacagaattctggacaatcaaaacttaactcctggatacaggt

SEQ ID NO: 4910 - DNA, 170 bp, Homo sapiens
tgaacttagtagtttgagattttcctaaatataatgtttacagtgtttttatattaatgattttttctgcttgataaaacttattaagttttcctttttgtagatgaaagccaaaaaattctaatatggtgcttatgttgtctaattaacaaagaaccacagaattctgg

SEQ ID NO: 4911 - DNA, 170 bp, Homo sapiens
gttatattcagggatacttgttctgtgaacttagtagtttgagattttcctaaatataatgtttacagtgtttttatattaatgattttttctgcttgataaaacttattaagttttcctttttgtagatgaaagccaaaaaattctaatatggtgcttatgttgtctaa

SEQ ID NO: 4912 - DNA, 170 bp, Homo sapiens
tgcacctatagattactatcctggtttgcttaaaaatgtgagtatttaaaatttatcacttttgaaatgtttaatgctgaatgtgccatcagcaaaaagagtaaatggaaatatttcagtcctccagaagagatgtttaacttttctttgtttatctcttcttaccttgg

SEQ ID NO: 4913 - DNA, 170 bp, Homo sapiens
tgctcttttcactcaaggtcttgggtatgcacctatagattactatcctggtttgcttaaaaatgtgagtatttaaaatttatcacttttgaaatgtttaatgctgaatgtgccatcagcaaaaagagtaaatggaaatatttcagtcctccagaagagatgtttaactt

SEQ ID NO: 4914 - DNA, 170 bp, Homo sapiens
gcactcagatttgataaagaagttgctcttttcactcaaggtcttgggtatgcacctatagattactatcctggtttgcttaaaaatgtgagtatttaaaatttatcacttttgaaatgtttaatgctgaatgtgccatcagcaaaaagagtaaatggaaatatttcagt

SEQ ID NO: 4915 - DNA, 170 bp, Homo sapiens
agggtgtattatctcatatactttcagcactcagatttgataaagaagttgctcttttcactcaaggtcttgggtatgcacctatagattactatcctggtttgcttaaaaatgtgagtatttaaaatttatcacttttgaaatgtttaatgctgaatgtgccatcagca

SEQ ID NO: 4916 - DNA, 170 bp, Homo sapiens
aactttttctgtttatgttttttagggtgtattatctcatatactttcagcactcagatttgataaagaagttgctcttttcactcaaggtcttgggtatgcacctatagattactatcctggtttgcttaaaaatgtgagtatttaaaatttatcacttttgaaatgtt

SEQ ID NO: 4917 - DNA, 170 bp, Homo sapiens
ggcacttgcatttacttttaaagaagttaactttttctgtttatgttttttagggtgtattatctcatatactttcagcactcagatttgataaagaagttgctcttttcactcaaggtcttgggtatgcacctatagattactatcctggtttgcttaaaaatgtgagt

SEQ ID NO: 4918 - DNA, 170 bp, Homo sapiens
ttgtaggcattgtacataaaaggcacttgcatttacttttaaagaagttaactttttctgtttatgttttttagggtgtattatctcatatactttcagcactcagatttgataaagaagttgctcttttcactcaaggtcttgggtatgcacctatagattactatcct

SEQ ID NO: 4919 - DNA, 170 bp, Homo sapiens
tgtttcatagagaccacccccatgtacaaataaattgtaggcattgtacataaaaggcacttgcatttacttttaaagaagttaactttttctgtttatgttttttagggtgtattatctcatatactttcagcactcagatttgataaagaagttgctcttttcactca

SEQ ID NO: 4920 - DNA, 170 bp, Homo sapiens
ggtactttgacaaacagatttttttgtttcatagagaccacccccatgtacaaataaattgtaggcattgtacataaaaggcacttgcatttacttttaaagaagttaactttttctgtttatgttttttagggtgtattatctcatatactttcagcactcagatttga

SEQ ID NO: 4921 - DNA, 170 bp, Homo sapiens
gaatcatcttaatggatttaacactcaaaggcggtaggtgttaaactaaacatccttcttctcaggtttcaaaatgtatcagtttggttatgagaggaaaattttacaattcataggaaatggatgttcagttatggttgtattttatatagaaagattattttagtgga

SEQ ID NO: 4922 - DNA, 170 bp, Homo sapiens
gttttatcattagcgtctgaactcagagagaatcatcttaatggatttaacactcaaaggcggtaggtgttaaactaaacatccttcttctcaggtttcaaaatgtatcagtttggttatgagaggaaaattttacaattcataggaaatggatgttcagttatggttgt

SEQ ID NO: 4923 - DNA, 170 bp, Homo sapiens
gattttgttttacagatggttttatcattagcgtctgaactcagagagaatcatcttaatggatttaacactcaaaggcggtaggtgttaaactaaacatccttcttctcaggtttcaaaatgtatcagtttggttatgagaggaaaattttacaattcataggaaatgg

SEQ ID NO: 4924 - DNA, 170 bp, Homo sapiens
tgcagcgtgagttaacctgcaactgattttgttttacagatggttttatcattagcgtctgaactcagagagaatcatcttaatggatttaacactcaaaggcggtaggtgttaaactaaacatccttcttctcaggtttcaaaatgtatcagtttggttatgagaggaa

SEQ ID NO: 4925 - DNA, 170 bp, Homo sapiens
ccaagaaaaatagaactgatgtaatcctgtttgcagcgtgagttaacctgcaactgattttgttttacagatggttttatcattagcgtctgaactcagagagaatcatcttaatggatttaacactcaaaggcggtaggtgttaaactaaacatccttcttctcaggtt

SEQ ID NO: 4926 - DNA, 170 bp, Homo sapiens
ctcaacggaaatatcactcacaccaagaaaaatagaactgatgtaatcctgtttgcagcgtgagttaacctgcaactgattttgttttacagatggttttatcattagcgtctgaactcagagagaatcatcttaatggatttaacactcaaaggcggtaggtgttaaac

SEQ ID NO: 4927 - DNA, 170 bp, Homo sapiens
gaagatgggggttgggggaatctcaacggaaatatcactcacaccaagaaaaatagaactgatgtaatcctgtttgcagcgtgagttaacctgcaactgattttgttttacagatggttttatcattagcgtctgaactcagagagaatcatcttaatggatttaacact

SEQ ID NO: 4928 - DNA, 170 bp, Homo sapiens
ccttttcactctgacagagtgaaacatgagaagatgggggttgggggaatctcaacggaaatatcactcacaccaagaaaaatagaactgatgtaatcctgtttgcagcgtgagttaacctgcaactgattttgttttacagatggttttatcattagcgtctgaactca

SEQ ID NO: 4929 - DNA, 170 bp, Homo sapiens
ccagccagagttctttgaggctgtaaacgaggccattttgctgtaagtggcaaatgtttcctgtcatcctgcgtcgtttttccttttcttagaaggctgtggtgtgttggaaagactgtacgacagcagtgtccaaacgtttttgtctcagtaccctttatactcttaaa

SEQ ID NO: 4930 - DNA, 170 bp, Homo sapiens
tggacgtgaacctcaggaaatcctccagccagagttctttgaggctgtaaacgaggccattttgctgtaagtggcaaatgtttcctgtcatcctgcgtcgtttttccttttcttagaaggctgtggtgtgttggaaagactgtacgacagcagtgtccaaacgtttttgt

SEQ ID NO: 4931 - DNA, 170 bp, Homo sapiens
agagtcattctctttatttagaggcaaaacaggtgatctgtctttgacctttttagcatgaaggtttttatatgtccttaattatgcatggctcttagatttgagtgattatttcttatttcttccatagaatggctcccgagcgagtggcgtccctgtcacgagtttgt

SEQ ID NO: 4932 - DNA, 170 bp, Homo sapiens
ggtggaggctctcctcatctgtcatggacgtgaacctcaggaaatcctccagccagagttctttgaggctgtaaacgaggccattttgctgtaagtggcaaatgtttcctgtcatcctgcgtcgtttttccttttcttagaaggctgtggtgtgttggaaagactgtacg

SEQ ID NO: 4933 - DNA, 170 bp, Homo sapiens
ttaccctgacagatgttgaccccctggtggaggctctcctcatctgtcatggacgtgaacctcaggaaatcctccagccagagttctttgaggctgtaaacgaggccattttgctgtaagtggcaaatgtttcctgtcatcctgcgtcgtttttccttttcttagaaggc

SEQ ID NO: 4934 - DNA, 170 bp, Homo sapiens
ccctgtcacgagtttgtgtcccacttattaccctgacagatgttgaccccctggtggaggctctcctcatctgtcatggacgtgaacctcaggaaatcctccagccagagttctttgaggctgtaaacgaggccattttgctgtaagtggcaaatgtttcctgtcatcct

SEQ ID NO: 4935 - DNA, 170 bp, Homo sapiens
tggctcccgagcgagtggcgtccctgtcacgagtttgtgtcccacttattaccctgacagatgttgaccccctggtggaggctctcctcatctgtcatggacgtgaacctcaggaaatcctccagccagagttctttgaggctgtaaacgaggccattttgctgtaagtg

SEQ ID NO: 4936 - DNA, 170 bp, Homo sapiens
tgagtgattatttcttatttcttccatagaatggctcccgagcgagtggcgtccctgtcacgagtttgtgtcccacttattaccctgacagatgttgaccccctggtggaggctctcctcatctgtcatggacgtgaacctcaggaaatcctccagccagagttctttga

SEQ ID NO: 4937 - DNA, 170 bp, Homo sapiens
ccttaattatgcatggctcttagatttgagtgattatttcttatttcttccatagaatggctcccgagcgagtggcgtccctgtcacgagtttgtgtcccacttattaccctgacagatgttgaccccctggtggaggctctcctcatctgtcatggacgtgaacctcag

SEQ ID NO: 4938 - DNA, 170 bp, Homo sapiens
tttttagcatgaaggtttttatatgtccttaattatgcatggctcttagatttgagtgattatttcttatttcttccatagaatggctcccgagcgagtggcgtccctgtcacgagtttgtgtcccacttattaccctgacagatgttgaccccctggtggaggctctcc

SEQ ID NO: 4939 - DNA, 170 bp, Homo sapiens
ggcaaaacaggtgatctgtctttgacctttttagcatgaaggtttttatatgtccttaattatgcatggctcttagatttgagtgattatttcttatttcttccatagaatggctcccgagcgagtggcgtccctgtcacgagtttgtgtcccacttattaccctgacag

SEQ ID NO: 4940 - DNA, 170 bp, Homo sapiens
gctttataaaagattcatcgctggtacgtactgggttttgatgaagggaaaaatccttgaaggagatgcttggaatcatttcttttagtcagagaatgaaagggggggatgtaaacaaaagagcaattggaacctttatatataatcgtgtatttacattttatttttga

SEQ ID NO: 4941 - DNA, 170 bp, Homo sapiens
agaaattgtctgagaaggatcgaatgctttataaaagattcatcgctggtacgtactgggttttgatgaagggaaaaatccttgaaggagatgcttggaatcatttcttttagtcagagaatgaaagggggggatgtaaacaaaagagcaattggaacctttatatataa

SEQ ID NO: 4942 - DNA, 170 bp, Homo sapiens
gctgtgaccatgatgagaagtctcacaaattggattagtgattgcattttgaactttttttaatcttcttttttcagtgagccatttctgtttaaaattttgtttatttctttctgaaaggaagaagatttctctccccatgtcagctgtagtctgcctctggcttcggc

SEQ ID NO: 4943 - DNA, 170 bp, Homo sapiens
gattctataaattattagccactgctgtgaccatgatgagaagtctcacaaattggattagtgattgcattttgaactttttttaatcttcttttttcagtgagccatttctgtttaaaattttgtttatttctttctgaaaggaagaagatttctctccccatgtcagc

SEQ ID NO: 4944 - DNA, 170 bp, Homo sapiens
tctttttgaaaagctaatctccagtgagagaaattgtctgagaaggatcgaatgctttataaaagattcatcgctggtacgtactgggttttgatgaagggaaaaatccttgaaggagatgcttggaatcatttcttttagtcagagaatgaaagggggggatgtaaaca

SEQ ID NO: 4945 - DNA, 170 bp, Homo sapiens
gccttgaaaaagcaatgctgcatctttttgaaaagctaatctccagtgagagaaattgtctgagaaggatcgaatgctttataaaagattcatcgctggtacgtactgggttttgatgaagggaaaaatccttgaaggagatgcttggaatcatttcttttagtcagaga

SEQ ID NO: 4946 - DNA, 170 bp, Homo sapiens
ctctggcttcggcaccttcccagccttgaaaaagcaatgctgcatctttttgaaaagctaatctccagtgagagaaattgtctgagaaggatcgaatgctttataaaagattcatcgctggtacgtactgggttttgatgaagggaaaaatccttgaaggagatgcttgg

SEQ ID NO: 4947 - DNA, 170 bp, Homo sapiens
tctccccatgtcagctgtagtctgcctctggcttcggcaccttcccagccttgaaaaagcaatgctgcatctttttgaaaagctaatctccagtgagagaaattgtctgagaaggatcgaatgctttataaaagattcatcgctggtacgtactgggttttgatgaaggg

SEQ ID NO: 4948 - DNA, 170 bp, Homo sapiens
ttatttctttctgaaaggaagaagatttctctccccatgtcagctgtagtctgcctctggcttcggcaccttcccagccttgaaaaagcaatgctgcatctttttgaaaagctaatctccagtgagagaaattgtctgagaaggatcgaatgctttataaaagattcatc

SEQ ID NO: 4949 - DNA, 170 bp, Homo sapiens
gagccatttctgtttaaaattttgtttatttctttctgaaaggaagaagatttctctccccatgtcagctgtagtctgcctctggcttcggcaccttcccagccttgaaaaagcaatgctgcatctttttgaaaagctaatctccagtgagagaaattgtctgagaagga

SEQ ID NO: 4950 - DNA, 170 bp, Homo sapiens
ctttttttaatcttcttttttcagtgagccatttctgtttaaaattttgtttatttctttctgaaaggaagaagatttctctccccatgtcagctgtagtctgcctctggcttcggcaccttcccagccttgaaaaagcaatgctgcatctttttgaaaagctaatctcc

SEQ ID NO: 4951 - DNA, 170 bp, Homo sapiens
tggattagtgattgcattttgaactttttttaatcttcttttttcagtgagccatttctgtttaaaattttgtttatttctttctgaaaggaagaagatttctctccccatgtcagctgtagtctgcctctggcttcggcaccttcccagccttgaaaaagcaatgctgc

SEQ ID NO: 4952 - DNA, 170 bp, Homo sapiens
ccctgccatattccgggttgttgatgagatgttcaggtaaacgttacactgtttcttctagtaattgatgtaaaaaaggttccatttccaagcatgaatcagaaaatgttgtggtagtctctggctgtatcatggggaaattagagtttctgattccctcctgttcctct

SEQ ID NO: 4953 - DNA, 170 bp, Homo sapiens
cttctccttttacagcctcaagcagcctgccaccctgccatattccgggttgttgatgagatgttcaggtaaacgttacactgtttcttctagtaattgatgtaaaaaaggttccatttccaagcatgaatcagaaaatgttgtggtagtctctggctgtatcatgggga

SEQ ID NO: 4954 - DNA, 170 bp, Homo sapiens
gtgatatttcacattctcatggtcttctccttttacagcctcaagcagcctgccaccctgccatattccgggttgttgatgagatgttcaggtaaacgttacactgtttcttctagtaattgatgtaaaaaaggttccatttccaagcatgaatcagaaaatgttgtggt

SEQ ID NO: 4955 - DNA, 170 bp, Homo sapiens
gcaagtttctgagaaagtgcttgtgatatttcacattctcatggtcttctccttttacagcctcaagcagcctgccaccctgccatattccgggttgttgatgagatgttcaggtaaacgttacactgtttcttctagtaattgatgtaaaaaaggttccatttccaagc

SEQ ID NO: 4956 - DNA, 170 bp, Homo sapiens
gtaactcctttggctgataatagcaagtttctgagaaagtgcttgtgatatttcacattctcatggtcttctccttttacagcctcaagcagcctgccaccctgccatattccgggttgttgatgagatgttcaggtaaacgttacactgtttcttctagtaattgatgt

SEQ ID NO: 4957 - DNA, 170 bp, Homo sapiens
cagttttctggacatcagcagttcccagtaactcctttggctgataatagcaagtttctgagaaagtgcttgtgatatttcacattctcatggtcttctccttttacagcctcaagcagcctgccaccctgccatattccgggttgttgatgagatgttcaggtaaacgt

SEQ ID NO: 4958 - DNA, 170 bp, Homo sapiens
tcgttcttctaaccaaaaggagtatgccagttttctggacatcagcagttcccagtaactcctttggctgataatagcaagtttctgagaaagtgcttgtgatatttcacattctcatggtcttctccttttacagcctcaagcagcctgccaccctgccatattccggg

SEQ ID NO: 4959 - DNA, 170 bp, Homo sapiens
ttgtagaagctctggagaaagcaagcaagcaggtttgttatatcacatatattactcattcatcccagagaataagacgctgttgagagtattttggacaagagcactttattttcaataattttgatggactgttttgctcacaaagaaaggttcctaatgagtgcccc

SEQ ID NO: 4960 - DNA, 170 bp, Homo sapiens
ccactattcaggtgtttacgcagtgctttgtagaagctctggagaaagcaagcaagcaggtttgttatatcacatatattactcattcatcccagagaataagacgctgttgagagtattttggacaagagcactttattttcaataattttgatggactgttttgctca

SEQ ID NO: 4961 - DNA, 170 bp, Homo sapiens
tggggccctggaaatcatagccactattcaggtgtttacgcagtgctttgtagaagctctggagaaagcaagcaagcaggtttgttatatcacatatattactcattcatcccagagaataagacgctgttgagagtattttggacaagagcactttattttcaataatt

SEQ ID NO: 4962 - DNA, 170 bp, Homo sapiens
tcaggtgtgcactcctggaaaccgatggggccctggaaatcatagccactattcaggtgtttacgcagtgctttgtagaagctctggagaaagcaagcaagcaggtttgttatatcacatatattactcattcatcccagagaataagacgctgttgagagtattttgga

SEQ ID NO: 4963 - DNA, 170 bp, Homo sapiens
acgtgttctgatctgactttgcattgttcaggtgtgcactcctggaaaccgatggggccctggaaatcatagccactattcaggtgtttacgcagtgctttgtagaagctctggagaaagcaagcaagcaggtttgttatatcacatatattactcattcatcccagaga

SEQ ID NO: 4964 - DNA, 170 bp, Homo sapiens
tcatgtttgccggattacttgttaaacgtgttctgatctgactttgcattgttcaggtgtgcactcctggaaaccgatggggccctggaaatcatagccactattcaggtgtttacgcagtgctttgtagaagctctggagaaagcaagcaagcaggtttgttatatcac

SEQ ID NO: 4965 - DNA, 170 bp, Homo sapiens
ctacttttcccttatacagtgcaggttttcatgtttgccggattacttgttaaacgtgttctgatctgactttgcattgttcaggtgtgcactcctggaaaccgatggggccctggaaatcatagccactattcaggtgtttacgcagtgctttgtagaagctctggaga

SEQ ID NO: 4966 - DNA, 170 bp, Homo sapiens
gcttatggcacaaaaaaagtgtttctacttttcccttatacagtgcaggttttcatgtttgccggattacttgttaaacgtgttctgatctgactttgcattgttcaggtgtgcactcctggaaaccgatggggccctggaaatcatagccactattcaggtgtttacgc

SEQ ID NO: 4967 - DNA, 170 bp, Homo sapiens
tgaaatctgatgagttgagatactgctgaagcttatggcacaaaaaaagtgtttctacttttcccttatacagtgcaggttttcatgtttgccggattacttgttaaacgtgttctgatctgactttgcattgttcaggtgtgcactcctggaaaccgatggggccctgg

SEQ ID NO: 4968 - DNA, 170 bp, Homo sapiens
ggctgggttgacctgaatactggatacagggcatataaaacaggggcaaggcacagactcatagcagagcaatcaccaccaagcctggaataactgcaagggctctgctgacatcttcctgaggtgccaaggaaatgaggatggaggaaggaatgaatgttctccatgac

SEQ ID NO: 4969 - DNA, 170 bp, Homo sapiens
acagggcatataaaacaggggcaaggcacagactcatagcagagcaatcaccaccaagcctggaataactgcaagggctctgctgacatcttcctgaggtgccaaggaaatgaggatggaggaaggaatgaatgttctccatgactttgggatccagtcaacacattacc

SEQ ID NO: 4970 - DNA, 170 bp, Homo sapiens
agacctcaggaatgccttctacgtcctcttccccatctggttccatcttcaggaagctgtgggcattaaactcctttgggtagctgtgattggagactggctcaacctcgtctttaagtggtaagaaccatatagagaggagatcagcaagaaaagaggctggcattcgc

SEQ ID NO: 4971 - DNA, 170 bp, Homo sapiens
tcttccccatctggttccatcttcaggaagctgtgggcattaaactcctttgggtagctgtgattggagactggctcaacctcgtctttaagtggtaagaaccatatagagaggagatcagcaagaaaagaggctggcattcgctctcgcaatgtctgtccatcagaagt

SEQ ID NO: 4972 - DNA, 170 bp, Homo sapiens
caggaagctgtgggcattaaactcctttgggtagctgtgattggagactggctcaacctcgtctttaagtggtaagaaccatatagagaggagatcagcaagaaaagaggctggcattcgctctcgcaatgtctgtccatcagaagttgctttccccaggctattcagga

SEQ ID NO: 4973 - DNA, 170 bp, Homo sapiens
ctttgggtagctgtgattggagactggctcaacctcgtctttaagtggtaagaaccatatagagaggagatcagcaagaaaagaggctggcattcgctctcgcaatgtctgtccatcagaagttgctttccccaggctattcaggaagccacgggctactcatgcttcca

SEQ ID NO: 4974 - DNA, 170 bp, Homo sapiens
gcacagactcatagcagagcaatcaccaccaagcctggaataactgcaagggctctgctgacatcttcctgaggtgccaaggaaatgaggatggaggaaggaatgaatgttctccatgactttgggatccagtcaacacattacctccaggtgaattaccaagactccca

SEQ ID NO: 4975 - DNA, 170 bp, Homo sapiens
accaccaagcctggaataactgcaagggctctgctgacatcttcctgaggtgccaaggaaatgaggatggaggaaggaatgaatgttctccatgactttgggatccagtcaacacattacctccaggtgaattaccaagactcccaggactggttcatcttggtgtccgt

SEQ ID NO: 4976 - DNA, 170 bp, Homo sapiens
gggctctgctgacatcttcctgaggtgccaaggaaatgaggatggaggaaggaatgaatgttctccatgactttgggatccagtcaacacattacctccaggtgaattaccaagactcccaggactggttcatcttggtgtccgtgatcgcagacctcaggaatgccttc

SEQ ID NO: 4977 - DNA, 170 bp, Homo sapiens
tgccaaggaaatgaggatggaggaaggaatgaatgttctccatgactttgggatccagtcaacacattacctccaggtgaattaccaagactcccaggactggttcatcttggtgtccgtgatcgcagacctcaggaatgccttctacgtcctcttccccatctggttcc

SEQ ID NO: 4978 - DNA, 170 bp, Homo sapiens
ggaaggaatgaatgttctccatgactttgggatccagtcaacacattacctccaggtgaattaccaagactcccaggactggttcatcttggtgtccgtgatcgcagacctcaggaatgccttctacgtcctcttccccatctggttccatcttcaggaagctgtgggca

SEQ ID NO: 4979 - DNA, 170 bp, Homo sapiens
gggatccagtcaacacattacctccaggtgaattaccaagactcccaggactggttcatcttggtgtccgtgatcgcagacctcaggaatgccttctacgtcctcttccccatctggttccatcttcaggaagctgtgggcattaaactcctttgggtagctgtgattgg

SEQ ID NO: 4980 - DNA, 170 bp, Homo sapiens
ggtgaattaccaagactcccaggactggttcatcttggtgtccgtgatcgcagacctcaggaatgccttctacgtcctcttccccatctggttccatcttcaggaagctgtgggcattaaactcctttgggtagctgtgattggagactggctcaacctcgtctttaagt

SEQ ID NO: 4981 - DNA, 170 bp, Homo sapiens
tcatcttggtgtccgtgatcgcagacctcaggaatgccttctacgtcctcttccccatctggttccatcttcaggaagctgtgggcattaaactcctttgggtagctgtgattggagactggctcaacctcgtctttaagtggtaagaaccatatagagaggagatcagc

SEQ ID NO: 4982 - DNA, 170 bp, Homo sapiens
ccagccacccagttctcccttctagaggcaacatgtgaaatccttctcaggctacactcttcttgaaggtgtaggctttgggcaaaagcattcattcagtaaccccagaaacttgttctgtttttccataggattctctttggacagcgtccatactggtgggttttgga

SEQ ID NO: 4983 - DNA, 170 bp, Homo sapiens
agaggcaacatgtgaaatccttctcaggctacactcttcttgaaggtgtaggctttgggcaaaagcattcattcagtaaccccagaaacttgttctgtttttccataggattctctttggacagcgtccatactggtgggttttggatactgactactacagcaacactt

SEQ ID NO: 4984 - DNA, 170 bp, Homo sapiens
aggctacactcttcttgaaggtgtaggctttgggcaaaagcattcattcagtaaccccagaaacttgttctgtttttccataggattctctttggacagcgtccatactggtgggttttggatactgactactacagcaacacttccgtgcccctgataaagcagttccc

SEQ ID NO: 4985 - DNA, 170 bp, Homo sapiens
ggctttgggcaaaagcattcattcagtaaccccagaaacttgttctgtttttccataggattctctttggacagcgtccatactggtgggttttggatactgactactacagcaacacttccgtgcccctgataaagcagttccctgtaacctgtgagactggaccaggt

SEQ ID NO: 4986 - DNA, 170 bp, Homo sapiens
tcagtaaccccagaaacttgttctgtttttccataggattctctttggacagcgtccatactggtgggttttggatactgactactacagcaacacttccgtgcccctgataaagcagttccctgtaacctgtgagactggaccaggtaagcgtcccagcccctgcagac

SEQ ID NO: 4987 - DNA, 170 bp, Homo sapiens
ttccataggattctctttggacagcgtccatactggtgggttttggatactgactactacagcaacacttccgtgcccctgataaagcagttccctgtaacctgtgagactggaccaggtaagcgtcccagcccctgcagacagaagctgagtggacctcgtttacctgt

SEQ ID NO: 4988 - DNA, 170 bp, Homo sapiens
tccatactggtgggttttggatactgactactacagcaacacttccgtgcccctgataaagcagttccctgtaacctgtgagactggaccaggtaagcgtcccagcccctgcagacagaagctgagtggacctcgtttacctgttatggatgaaactgaccttgagggga

SEQ ID NO: 4989 - DNA, 170 bp, Homo sapiens
ctgactactacagcaacacttccgtgcccctgataaagcagttccctgtaacctgtgagactggaccaggtaagcgtcccagcccctgcagacagaagctgagtggacctcgtttacctgttatggatgaaactgaccttgaggggacatgaggagagccattcctttgt

SEQ ID NO: 4990 - DNA, 170 bp, Homo sapiens
cccctgataaagcagttccctgtaacctgtgagactggaccaggtaagcgtcccagcccctgcagacagaagctgagtggacctcgtttacctgttatggatgaaactgaccttgaggggacatgaggagagccattcctttgtacttttgtcatgctcttcaattggca

SEQ ID NO: 4991 - DNA, 170 bp, Homo sapiens
gggggtgaatggatggatgaatgggtagatgggtggatagggggatggctgggtggctgggtagatgatgcactgtctcccagatgaggaccttttcacctttactccattctctttcctgccctttagggagcccctctggccatgccatgggcacagcaggtgtatac

SEQ ID NO: 4992 - DNA, 170 bp, Homo sapiens
tggatagggggatggctgggtggctgggtagatgatgcactgtctcccagatgaggaccttttcacctttactccattctctttcctgccctttagggagcccctctggccatgccatgggcacagcaggtgtatactacgtgatggtcacatctactctttccatcttt

SEQ ID NO: 4993 - DNA, 170 bp, Homo sapiens
gggtggctgggtagatgatgcactgtctcccagatgaggaccttttcacctttactccattctctttcctgccctttagggagcccctctggccatgccatgggcacagcaggtgtatactacgtgatggtcacatctactctttccatctttcagggaaagataaagcc

SEQ ID NO: 4994 - DNA, 170 bp, Homo sapiens
cccagatgaggaccttttcacctttactccattctctttcctgccctttagggagcccctctggccatgccatgggcacagcaggtgtatactacgtgatggtcacatctactctttccatctttcagggaaagataaagccgacctacagatttcggtaagaactcacc

SEQ ID NO: 4995 - DNA, 170 bp, Homo sapiens
ttactccattctctttcctgccctttagggagcccctctggccatgccatgggcacagcaggtgtatactacgtgatggtcacatctactctttccatctttcagggaaagataaagccgacctacagatttcggtaagaactcaccactggggtgtaggtggtggaggg

SEQ ID NO: 4996 - DNA, 170 bp, Homo sapiens
ggagcccctctggccatgccatgggcacagcaggtgtatactacgtgatggtcacatctactctttccatctttcagggaaagataaagccgacctacagatttcggtaagaactcaccactggggtgtaggtggtggagggcaggaggcagctctctctgtagctgaca

SEQ ID NO: 4997 - DNA, 170 bp, Homo sapiens
gcacagcaggtgtatactacgtgatggtcacatctactctttccatctttcagggaaagataaagccgacctacagatttcggtaagaactcaccactggggtgtaggtggtggagggcaggaggcagctctctctgtagctgacacaccacgtattcttcctcacatcc

SEQ ID NO: 4998 - DNA, 170 bp, Homo sapiens
gtgatggtcacatctactctttccatctttcagggaaagataaagccgacctacagatttcggtaagaactcaccactggggtgtaggtggtggagggcaggaggcagctctctctgtagctgacacaccacgtattcttcctcacatccccctagcccgctcccacacc

SEQ ID NO: 4999 - DNA, 170 bp, Homo sapiens
cagggaaagataaagccgacctacagatttcggtaagaactcaccactggggtgtaggtggtggagggcaggaggcagctctctctgtagctgacacaccacgtattcttcctcacatccccctagcccgctcccacacctgggcagccgctgattaagagttgtggcac

SEQ ID NO: 5000 - DNA, 170 bp, Homo sapiens
agtactggctttaatttacaaaaattccactgagagcacctaagtttgccaggctccaacatttctgcaggggctgttttctttgctgaaggatctgcacctgtgttctgttatggttgcctcttctgttgcaggtgcttgaatgtcattttgtggttgggattctgggc

SEQ ID NO: 5001 - DNA, 170 bp, Homo sapiens
actgagagcacctaagtttgccaggctccaacatttctgcaggggctgttttctttgctgaaggatctgcacctgtgttctgttatggttgcctcttctgttgcaggtgcttgaatgtcattttgtggttgggattctgggctgtgcagctgaatgtctgtctgtcacga

SEQ ID NO: 5002 - DNA, 170 bp, Homo sapiens
tccaacatttctgcaggggctgttttctttgctgaaggatctgcacctgtgttctgttatggttgcctcttctgttgcaggtgcttgaatgtcattttgtggttgggattctgggctgtgcagctgaatgtctgtctgtcacgaatctaccttgctgctcattttcctca

SEQ ID NO: 5003 - DNA, 170 bp, Homo sapiens
tctttgctgaaggatctgcacctgtgttctgttatggttgcctcttctgttgcaggtgcttgaatgtcattttgtggttgggattctgggctgtgcagctgaatgtctgtctgtcacgaatctaccttgctgctcattttcctcatcaagttgttgctggagtcctgtca

SEQ ID NO: 5004 - DNA, 170 bp, Homo sapiens
gtgttctgttatggttgcctcttctgttgcaggtgcttgaatgtcattttgtggttgggattctgggctgtgcagctgaatgtctgtctgtcacgaatctaccttgctgctcattttcctcatcaagttgttgctggagtcctgtcaggtatgggctgatctgactccct

SEQ ID NO: 5005 - DNA, 170 bp, Homo sapiens
gttgcaggtgcttgaatgtcattttgtggttgggattctgggctgtgcagctgaatgtctgtctgtcacgaatctaccttgctgctcattttcctcatcaagttgttgctggagtcctgtcaggtatgggctgatctgactcccttccttctcccccaaaccccattccg

SEQ ID NO: 5006 - DNA, 170 bp, Homo sapiens
gttgggattctgggctgtgcagctgaatgtctgtctgtcacgaatctaccttgctgctcattttcctcatcaagttgttgctggagtcctgtcaggtatgggctgatctgactcccttccttctcccccaaaccccattccgtttctctccctaatcaggacaaaatccc

SEQ ID NO: 5007 - DNA, 170 bp, Homo sapiens
gctgaatgtctgtctgtcacgaatctaccttgctgctcattttcctcatcaagttgttgctggagtcctgtcaggtatgggctgatctgactcccttccttctcccccaaaccccattccgtttctctccctaatcaggacaaaatcccagcattccagccacatcctgt

SEQ ID NO: 5008 - DNA, 170 bp, Homo sapiens
tgctgctcattttcctcatcaagttgttgctggagtcctgtcaggtatgggctgatctgactcccttccttctcccccaaaccccattccgtttctctccctaatcaggacaaaatcccagcattccagccacatcctgtgtgtaatcagtactgttagcatttctgtgg

SEQ ID NO: 5009 - DNA, 170 bp, Homo sapiens
aggcgaccctcccatctgccatctgtgatttaattccacagtcgcagaacggatggcatgtcacccactcctccaaacccacctctagcaaaggtcccaaatccttcctatctctcacagtcatgctttcttccactcaggcattgctgttgcagaaactttcagccaca

SEQ ID NO: 5010 - DNA, 170 bp, Homo sapiens
gtgatttaattccacagtcgcagaacggatggcatgtcacccactcctccaaacccacctctagcaaaggtcccaaatccttcctatctctcacagtcatgctttcttccactcaggcattgctgttgcagaaactttcagccacatccacagcatctataatgccagcc

SEQ ID NO: 5011 - DNA, 170 bp, Homo sapiens
tgctgctcaagggactgggtgtagacctcctgtggactctggagaaagcccagaggtggtgcgagcagccagaatgggtccacattgacaccacaccctttgccagcctcctcaagaacctgggcacgctctttggcctggggctggctctcaactccagcatgtacagg

SEQ ID NO: 5012 - DNA, 170 bp, Homo sapiens
acctcctgtggactctggagaaagcccagaggtggtgcgagcagccagaatgggtccacattgacaccacaccctttgccagcctcctcaagaacctgggcacgctctttggcctggggctggctctcaactccagcatgtacagggagagctgcaaggggaaactcagc

SEQ ID NO: 5013 - DNA, 170 bp, Homo sapiens
aggtggtgcgagcagccagaatgggtccacattgacaccacaccctttgccagcctcctcaagaacctgggcacgctctttggcctggggctggctctcaactccagcatgtacagggagagctgcaaggggaaactcagcaagtggctcccattccgcctcagctctat

SEQ ID NO: 5014 - DNA, 170 bp, Homo sapiens
tgggtccacattgacaccacaccctttgccagcctcctcaagaacctgggcacgctctttggcctggggctggctctcaactccagcatgtacagggagagctgcaaggggaaactcagcaagtggctcccattccgcctcagctctattgtagcctccctcgtcctcct

SEQ ID NO: 5015 - DNA, 170 bp, Homo sapiens
tgccagcctcctcaagaacctgggcacgctctttggcctggggctggctctcaactccagcatgtacagggagagctgcaaggggaaactcagcaagtggctcccattccgcctcagctctattgtagcctccctcgtcctcctgcacgtctttgactccttgaaacccc

SEQ ID NO: 5016 - DNA, 170 bp, Homo sapiens
cgctctttggcctggggctggctctcaactccagcatgtacagggagagctgcaaggggaaactcagcaagtggctcccattccgcctcagctctattgtagcctccctcgtcctcctgcacgtctttgactccttgaaacccccatcccaagtcgagctggtcttctac

SEQ ID NO: 5017 - DNA, 170 bp, Homo sapiens
ctcaactccagcatgtacagggagagctgcaaggggaaactcagcaagtggctcccattccgcctcagctctattgtagcctccctcgtcctcctgcacgtctttgactccttgaaacccccatcccaagtcgagctggtcttctacgtcttgtccttctgcaagagtgc

SEQ ID NO: 5018 - DNA, 170 bp, Homo sapiens
agagctgcaaggggaaactcagcaagtggctcccattccgcctcagctctattgtagcctccctcgtcctcctgcacgtctttgactccttgaaacccccatcccaagtcgagctggtcttctacgtcttgtccttctgcaagagtgcggtagtgcccctggcatccgtc

SEQ ID NO: 5019 - DNA, 170 bp, Homo sapiens
gtggctcccattccgcctcagctctattgtagcctccctcgtcctcctgcacgtctttgactccttgaaacccccatcccaagtcgagctggtcttctacgtcttgtccttctgcaagagtgcggtagtgcccctggcatccgtcagtgtcatcccctactgcctcgccc

SEQ ID NO: 5020 - DNA, 170 bp, Homo sapiens
ttgtagcctccctcgtcctcctgcacgtctttgactccttgaaacccccatcccaagtcgagctggtcttctacgtcttgtccttctgcaagagtgcggtagtgcccctggcatccgtcagtgtcatcccctactgcctcgcccaggtcctgggccagccgcacaagaag

SEQ ID NO: 5021 - DNA, 170 bp, Homo sapiens
ggcatgtcacccactcctccaaacccacctctagcaaaggtcccaaatccttcctatctctcacagtcatgctttcttccactcaggcattgctgttgcagaaactttcagccacatccacagcatctataatgccagcctcaagaaatattttctcattaccttcttcc

SEQ ID NO: 5022 - DNA, 170 bp, Homo sapiens
cgtctttgactccttgaaacccccatcccaagtcgagctggtcttctacgtcttgtccttctgcaagagtgcggtagtgcccctggcatccgtcagtgtcatcccctactgcctcgcccaggtcctgggccagccgcacaagaagtcgttgtaagagatgtggagtcttc

SEQ ID NO: 5023 - DNA, 170 bp, Homo sapiens
cccaagtcgagctggtcttctacgtcttgtccttctgcaagagtgcggtagtgcccctggcatccgtcagtgtcatcccctactgcctcgcccaggtcctgggccagccgcacaagaagtcgttgtaagagatgtggagtcttcggtgtttaaagtcaacaaccatgcca

SEQ ID NO: 5024 - DNA, 170 bp, Homo sapiens
gtccttctgcaagagtgcggtagtgcccctggcatccgtcagtgtcatcccctactgcctcgcccaggtcctgggccagccgcacaagaagtcgttgtaagagatgtggagtcttcggtgtttaaagtcaacaaccatgccagggattgaggaggactactatttgaagc

SEQ ID NO: 5025 - DNA, 170 bp, Homo sapiens
gcccctggcatccgtcagtgtcatcccctactgcctcgcccaggtcctgggccagccgcacaagaagtcgttgtaagagatgtggagtcttcggtgtttaaagtcaacaaccatgccagggattgaggaggactactatttgaagcaatgggcactggtatttggagcaa

SEQ ID NO: 5026 - DNA, 170 bp, Homo sapiens
ccctactgcctcgcccaggtcctgggccagccgcacaagaagtcgttgtaagagatgtggagtcttcggtgtttaaagtcaacaaccatgccagggattgaggaggactactatttgaagcaatgggcactggtatttggagcaagtgacatgccatccattctgccgtc

SEQ ID NO: 5027 - DNA, 170 bp, Homo sapiens
gccagccgcacaagaagtcgttgtaagagatgtggagtcttcggtgtttaaagtcaacaaccatgccagggattgaggaggactactatttgaagcaatgggcactggtatttggagcaagtgacatgccatccattctgccgtcgtggaattaaatcacggatggcaga

SEQ ID NO: 5028 - DNA, 170 bp, Homo sapiens
caaacccacctctagcaaaggtcccaaatccttcctatctctcacagtcatgctttcttccactcaggcattgctgttgcagaaactttcagccacatccacagcatctataatgccagcctcaagaaatattttctcattaccttcttcctgttcagcttcgccatcgg

SEQ ID NO: 5029 - DNA, 170 bp, Homo sapiens
ccaaatccttcctatctctcacagtcatgctttcttccactcaggcattgctgttgcagaaactttcagccacatccacagcatctataatgccagcctcaagaaatattttctcattaccttcttcctgttcagcttcgccatcggattttatctgctgctcaagggac

SEQ ID NO: 5030 - DNA, 170 bp, Homo sapiens
tgctttcttccactcaggcattgctgttgcagaaactttcagccacatccacagcatctataatgccagcctcaagaaatattttctcattaccttcttcctgttcagcttcgccatcggattttatctgctgctcaagggactgggtgtagacctcctgtggactctgg

SEQ ID NO: 5031 - DNA, 170 bp, Homo sapiens
tgttgcagaaactttcagccacatccacagcatctataatgccagcctcaagaaatattttctcattaccttcttcctgttcagcttcgccatcggattttatctgctgctcaagggactgggtgtagacctcctgtggactctggagaaagcccagaggtggtgcgagc

SEQ ID NO: 5032 - DNA, 170 bp, Homo sapiens
acagcatctataatgccagcctcaagaaatattttctcattaccttcttcctgttcagcttcgccatcggattttatctgctgctcaagggactgggtgtagacctcctgtggactctggagaaagcccagaggtggtgcgagcagccagaatgggtccacattgacacc

SEQ ID NO: 5033 - DNA, 170 bp, Homo sapiens
caagaaatattttctcattaccttcttcctgttcagcttcgccatcggattttatctgctgctcaagggactgggtgtagacctcctgtggactctggagaaagcccagaggtggtgcgagcagccagaatgggtccacattgacaccacaccctttgccagcctcctca

SEQ ID NO: 5034 - DNA, 170 bp, Homo sapiens
ctgttcagcttcgccatcggattttatctgctgctcaagggactgggtgtagacctcctgtggactctggagaaagcccagaggtggtgcgagcagccagaatgggtccacattgacaccacaccctttgccagcctcctcaagaacctgggcacgctctttggcctggg

SEQ ID NO: 5035 - DNA, 170 bp, Homo sapiens
tgaccctgaggggatggagttttcaagtccttccagagaggtaagagagagagctcccaatcagcattgtcacagtgcttctggaatcctggcactggaatttaatgaatgacagactctctttgaatccagggccatcatggctctttgagcaaggcacagatggaggg

SEQ ID NO: 5036 - DNA, 170 bp, Homo sapiens
tcttctcttcatctaatgaccctgaggggatggagttttcaagtccttccagagaggtaagagagagagctcccaatcagcattgtcacagtgcttctggaatcctggcactggaatttaatgaatgacagactctctttgaatccagggccatcatggctctttgagca

SEQ ID NO: 5037 - DNA, 170 bp, Homo sapiens
tccttcagagactctggaacccctgtggtcttctcttcatctaatgaccctgaggggatggagttttcaagtccttccagagaggtaagagagagagctcccaatcagcattgtcacagtgcttctggaatcctggcactggaatttaatgaatgacagactctctttga

SEQ ID NO: 5038 - DNA, 170 bp, Homo sapiens
tccttgtttttgtttagtggatcctctatccttcagagactctggaacccctgtggtcttctcttcatctaatgaccctgaggggatggagttttcaagtccttccagagaggtaagagagagagctcccaatcagcattgtcacagtgcttctggaatcctggcactgg

SEQ ID NO: 5039 - DNA, 170 bp, Homo sapiens
agctaaggcaggtacctgcatccttgtttttgtttagtggatcctctatccttcagagactctggaacccctgtggtcttctcttcatctaatgaccctgaggggatggagttttcaagtccttccagagaggtaagagagagagctcccaatcagcattgtcacagtgc

SEQ ID NO: 5040 - DNA, 170 bp, Homo sapiens
acttgcagggctaacctagtgcctatagctaaggcaggtacctgcatccttgtttttgtttagtggatcctctatccttcagagactctggaacccctgtggtcttctcttcatctaatgaccctgaggggatggagttttcaagtccttccagagaggtaagagagaga

SEQ ID NO: 5041 - DNA, 170 bp, Homo sapiens
ggctctgctgttgtggtcgtgctaaaccggtgagggcaatggtgaggtctgggaagtgggctgaagacagcgttgggggccttggcaggatcacactctcagcttctcctccctgctccctagctcctctaaggatgtgcctcttaccatcaaggatcctgctgtgggct

SEQ ID NO: 5042 - DNA, 170 bp, Homo sapiens
cgcagtggcactgatgcatcccgatggctctgctgttgtggtcgtgctaaaccggtgagggcaatggtgaggtctgggaagtgggctgaagacagcgttgggggccttggcaggatcacactctcagcttctcctccctgctccctagctcctctaaggatgtgcctctt

SEQ ID NO: 5043 - DNA, 170 bp, Homo sapiens
gttgccagtcagaagaacgacctggacgcagtggcactgatgcatcccgatggctctgctgttgtggtcgtgctaaaccggtgagggcaatggtgaggtctgggaagtgggctgaagacagcgttgggggccttggcaggatcacactctcagcttctcctccctgctcc

SEQ ID NO: 5044 - DNA, 170 bp, Homo sapiens
tgagggctcccagagagtggggctggttgccagtcagaagaacgacctggacgcagtggcactgatgcatcccgatggctctgctgttgtggtcgtgctaaaccggtgagggcaatggtgaggtctgggaagtgggctgaagacagcgttgggggccttggcaggatcac

SEQ ID NO: 5045 - DNA, 170 bp, Homo sapiens
ttcccacattcagcaagttcattcctgagggctcccagagagtggggctggttgccagtcagaagaacgacctggacgcagtggcactgatgcatcccgatggctctgctgttgtggtcgtgctaaaccggtgagggcaatggtgaggtctgggaagtgggctgaagaca

SEQ ID NO: 5046 - DNA, 170 bp, Homo sapiens
ccccgagggactctgaccatctgttcccacattcagcaagttcattcctgagggctcccagagagtggggctggttgccagtcagaagaacgacctggacgcagtggcactgatgcatcccgatggctctgctgttgtggtcgtgctaaaccggtgagggcaatggtgag

SEQ ID NO: 5047 - DNA, 170 bp, Homo sapiens
cttcttagatgagggtttcatgggaggtaccccgagggactctgaccatctgttcccacattcagcaagttcattcctgagggctcccagagagtggggctggttgccagtcagaagaacgacctggacgcagtggcactgatgcatcccgatggctctgctgttgtggt

SEQ ID NO: 5048 - DNA, 170 bp, Homo sapiens
gtgggtccgtgggtgggtgacttcttagatgagggtttcatgggaggtaccccgagggactctgaccatctgttcccacattcagcaagttcattcctgagggctcccagagagtggggctggttgccagtcagaagaacgacctggacgcagtggcactgatgcatccc

SEQ ID NO: 5049 - DNA, 170 bp, Homo sapiens
ggcagagcctctgcaggagttatggggtgggtccgtgggtgggtgacttcttagatgagggtttcatgggaggtaccccgagggactctgaccatctgttcccacattcagcaagttcattcctgagggctcccagagagtggggctggttgccagtcagaagaacgacc

SEQ ID NO: 5050 - DNA, 170 bp, Homo sapiens
gcatggctccaggcctagagagccagggcagagcctctgcaggagttatggggtgggtccgtgggtgggtgacttcttagatgagggtttcatgggaggtaccccgagggactctgaccatctgttcccacattcagcaagttcattcctgagggctcccagagagtggg

SEQ ID NO: 5051 - DNA, 170 bp, Homo sapiens
acctgtggcgtcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactca

SEQ ID NO: 5052 - DNA, 170 bp, Homo sapiens
tcacctggctactccattcacacctacctgtggcgtcgccagtgatggagcagatactcaaggaggcactgggctcagcctgggcattaaagggacagagtcagctcacacgctgtctgtgactaaagagggcacagcagggccagtgtgagcttacagcgacgtaagcc

SEQ ID NO: 5053 - DNA, 170 bp, Homo sapiens
ctgctgtgggcttcctggagacaatctcacctggctactccattcacacctacctgtggcgtcgccagtgatggagcagatactcaaggaggcactgggctcagcctgggcattaaagggacagagtcagctcacacgctgtctgtgactaaagagggcacagcagggcc

SEQ ID NO: 5054 - DNA, 170 bp, Homo sapiens
ggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggacagagtcagctcacacgctgtct

SEQ ID NO: 5055 - DNA, 170 bp, Homo sapiens
ccctgctccctagctcctctaaggatgtgcctcttaccatcaaggatcctgctgtgggcttcctggagacaatctcacctggctactccattcacacctacctgtggcgtcgccagtgatggagcagatactcaaggaggcactgggctcagcctgggcattaaagggac

SEQ ID NO: 5056 - DNA, 170 bp, Homo sapiens
gcaggatcacactctcagcttctcctccctgctccctagctcctctaaggatgtgcctcttaccatcaaggatcctgctgtgggcttcctggagacaatctcacctggctactccattcacacctacctgtggcgtcgccagtgatggagcagatactcaaggaggcact

SEQ ID NO: 5057 - DNA, 170 bp, Homo sapiens
gctgaagacagcgttgggggccttggcaggatcacactctcagcttctcctccctgctccctagctcctctaaggatgtgcctcttaccatcaaggatcctgctgtgggcttcctggagacaatctcacctggctactccattcacacctacctgtggcgtcgccagtga

SEQ ID NO: 5058 - DNA, 170 bp, Homo sapiens
ggcaatggtgaggtctgggaagtgggctgaagacagcgttgggggccttggcaggatcacactctcagcttctcctccctgctccctagctcctctaaggatgtgcctcttaccatcaaggatcctgctgtgggcttcctggagacaatctcacctggctactccattca

SEQ ID NO: 5059 - DNA, 170 bp, Homo sapiens
ctgttgtggtcgtgctaaaccggtgagggcaatggtgaggtctgggaagtgggctgaagacagcgttgggggccttggcaggatcacactctcagcttctcctccctgctccctagctcctctaaggatgtgcctcttaccatcaaggatcctgctgtgggcttcctgga

SEQ ID NO: 5060 - DNA, 170 bp, Homo sapiens
tgatgcatcccgatggctctgctgttgtggtcgtgctaaaccggtgagggcaatggtgaggtctgggaagtgggctgaagacagcgttgggggccttggcaggatcacactctcagcttctcctccctgctccctagctcctctaaggatgtgcctcttaccatcaagga

SEQ ID NO: 5061 - DNA, 170 bp, Homo sapiens
ggcagtgtcgtgggcatcaggtgagtgagtcaaggcagtggggaggtagcacagagcctcccttctgcctcatagtcctttggtagccttccagtaagctggtggtagacttttagtaggtgctcaataaatccttttgagtgactgagaccaactttggggtgaggatt

SEQ ID NO: 5062 - DNA, 170 bp, Homo sapiens
cctcacaggattgcttctacttcaggcagtgtcgtgggcatcaggtgagtgagtcaaggcagtggggaggtagcacagagcctcccttctgcctcatagtcctttggtagccttccagtaagctggtggtagacttttagtaggtgctcaataaatccttttgagtgact

SEQ ID NO: 5063 - DNA, 170 bp, Homo sapiens
agggtaagcatcatggctggcagcctcacaggattgcttctacttcaggcagtgtcgtgggcatcaggtgagtgagtcaaggcagtggggaggtagcacagagcctcccttctgcctcatagtcctttggtagccttccagtaagctggtggtagacttttagtaggtgc

SEQ ID NO: 5064 - DNA, 170 bp, Homo sapiens
tcctcaggaatgtcccaagcctttgagtagggtaagcatcatggctggcagcctcacaggattgcttctacttcaggcagtgtcgtgggcatcaggtgagtgagtcaaggcagtggggaggtagcacagagcctcccttctgcctcatagtcctttggtagccttccagt

SEQ ID NO: 5065 - DNA, 170 bp, Homo sapiens
cttgcttttcagtcattcctcattctgtcctcaggaatgtcccaagcctttgagtagggtaagcatcatggctggcagcctcacaggattgcttctacttcaggcagtgtcgtgggcatcaggtgagtgagtcaaggcagtggggaggtagcacagagcctcccttctgc

SEQ ID NO: 5066 - DNA, 170 bp, Homo sapiens
gagtagttgaggggtggagaggggcttgcttttcagtcattcctcattctgtcctcaggaatgtcccaagcctttgagtagggtaagcatcatggctggcagcctcacaggattgcttctacttcaggcagtgtcgtgggcatcaggtgagtgagtcaaggcagtgggga

SEQ ID NO: 5067 - DNA, 170 bp, Homo sapiens
aaggcagctaagccctgcccaggagagtagttgaggggtggagaggggcttgcttttcagtcattcctcattctgtcctcaggaatgtcccaagcctttgagtagggtaagcatcatggctggcagcctcacaggattgcttctacttcaggcagtgtcgtgggcatcag

SEQ ID NO: 5068 - DNA, 170 bp, Homo sapiens
ggagaccgggccatgggcacccaaaggcagctaagccctgcccaggagagtagttgaggggtggagaggggcttgcttttcagtcattcctcattctgtcctcaggaatgtcccaagcctttgagtagggtaagcatcatggctggcagcctcacaggattgcttctact

SEQ ID NO: 5069 - DNA, 170 bp, Homo sapiens
ctgtgggccttgtcctaatgaatgtgggagaccgggccatgggcacccaaaggcagctaagccctgcccaggagagtagttgaggggtggagaggggcttgcttttcagtcattcctcattctgtcctcaggaatgtcccaagcctttgagtagggtaagcatcatggct

SEQ ID NO: 5070 - DNA, 170 bp, Homo sapiens
ggggcccatccaggctaatcacacgggcacaggtaaccattacacccctcaccccctgggccaggctgggtcctcctagaggtaaatggtgtcagtgatcaccatggagtttcccgctgggtactgatacccttattccctgtggatgtcctcaggcctgctactgaccc

SEQ ID NO: 5071 - DNA, 170 bp, Homo sapiens
tgggcgacggatggagctgagtatggggcccatccaggctaatcacacgggcacaggtaaccattacacccctcaccccctgggccaggctgggtcctcctagaggtaaatggtgtcagtgatcaccatggagtttcccgctgggtactgatacccttattccctgtgga

SEQ ID NO: 5072 - DNA, 170 bp, Homo sapiens
attttgaaaccgtgttcagtctctcctagcagatgtgtccattctccatgtcttcatcagacctcactctgcttgtactccctccctcccaggtgcccgcccctgcatccctaaaagcttcggctacagctcggtggtgtgtgtctgcaatgccacatactgtgactcct

SEQ ID NO: 5073 - DNA, 170 bp, Homo sapiens
cgcccggccaaggggtgaggaattttgaaaccgtgttcagtctctcctagcagatgtgtccattctccatgtcttcatcagacctcactctgcttgtactccctccctcccaggtgcccgcccctgcatccctaaaagcttcggctacagctcggtggtgtgtgtctgca

SEQ ID NO: 5074 - DNA, 170 bp, Homo sapiens
aagtgctaggattacaggtgtgagcccctgcgcccggccaaggggtgaggaattttgaaaccgtgttcagtctctcctagcagatgtgtccattctccatgtcttcatcagacctcactctgcttgtactccctccctcccaggtgcccgcccctgcatccctaaaagct

SEQ ID NO: 5075 - DNA, 170 bp, Homo sapiens
ccttcagccgctatgagagtacacgcagtgggcgacggatggagctgagtatggggcccatccaggctaatcacacgggcacaggtaaccattacacccctcaccccctgggccaggctgggtcctcctagaggtaaatggtgtcagtgatcaccatggagtttcccgct

SEQ ID NO: 5076 - DNA, 170 bp, Homo sapiens
ccgacctttcctgcccttggtaccttcagccgctatgagagtacacgcagtgggcgacggatggagctgagtatggggcccatccaggctaatcacacgggcacaggtaaccattacacccctcaccccctgggccaggctgggtcctcctagaggtaaatggtgtcagt

SEQ ID NO: 5077 - DNA, 170 bp, Homo sapiens
caatgccacatactgtgactcctttgaccccccgacctttcctgcccttggtaccttcagccgctatgagagtacacgcagtgggcgacggatggagctgagtatggggcccatccaggctaatcacacgggcacaggtaaccattacacccctcaccccctgggccagg

SEQ ID NO: 5078 - DNA, 170 bp, Homo sapiens
cagctcggtggtgtgtgtctgcaatgccacatactgtgactcctttgaccccccgacctttcctgcccttggtaccttcagccgctatgagagtacacgcagtgggcgacggatggagctgagtatggggcccatccaggctaatcacacgggcacaggtaaccattaca

SEQ ID NO: 5079 - DNA, 170 bp, Homo sapiens
gcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggatggagctgagtatggggcccatccaggct

SEQ ID NO: 5080 - DNA, 170 bp, Homo sapiens
gtactccctccctcccaggtgcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggatggag

SEQ ID NO: 5081 - DNA, 170 bp, Homo sapiens
tccatgtcttcatcagacctcactctgcttgtactccctccctcccaggtgcccgcccctgcatccctaaaagcttcggctacagctcggtggtgtgtgtctgcaatgccacatactgtgactcctttgaccccccgacctttcctgcccttggtaccttcagccgctat

SEQ ID NO: 5082 - DNA, 170 bp, Homo sapiens
ctcctagcagatgtgtccattctccatgtcttcatcagacctcactctgcttgtactccctccctcccaggtgcccgcccctgcatccctaaaagcttcggctacagctcggtggtgtgtgtctgcaatgccacatactgtgactcctttgaccccccgacctttcctgc

SEQ ID NO: 5083 - DNA, 170 bp, Homo sapiens
aaatcgtacttctctgaagaaggtgaggaggaaggggacaagatgacatagagccattgaaacttttcgtttttcttttctttttttaaaatttttttgaggcagaatctcactctgcccattctgtcggcgagacaggagtgcagtggtgtgatctcccctcacagcaa

SEQ ID NO: 5084 - DNA, 170 bp, Homo sapiens
ccccctgcccaaaatttgctacttaaatcgtacttctctgaagaaggtgaggaggaaggggacaagatgacatagagccattgaaacttttcgtttttcttttctttttttaaaatttttttgaggcagaatctcactctgcccattctgtcggcgagacaggagtgcag

SEQ ID NO: 5085 - DNA, 170 bp, Homo sapiens
aaccattacacccctcaccccctgggccaggctgggtcctcctagaggtaaatggtgtcagtgatcaccatggagtttcccgctgggtactgatacccttattccctgtggatgtcctcaggcctgctactgaccctgcagccagaacagaagttccagaaagtgaaggg

SEQ ID NO: 5086 - DNA, 170 bp, Homo sapiens
tgctctcaacatccttgccctgtcaccccctgcccaaaatttgctacttaaatcgtacttctctgaagaaggtgaggaggaaggggacaagatgacatagagccattgaaacttttcgtttttcttttctttttttaaaatttttttgaggcagaatctcactctgccca

SEQ ID NO: 5087 - DNA, 170 bp, Homo sapiens
ggggccatgacagatgctgctgctctcaacatccttgccctgtcaccccctgcccaaaatttgctacttaaatcgtacttctctgaagaaggtgaggaggaaggggacaagatgacatagagccattgaaacttttcgtttttcttttctttttttaaaatttttttgag

SEQ ID NO: 5088 - DNA, 170 bp, Homo sapiens
gaacagaagttccagaaagtgaagggatttggaggggccatgacagatgctgctgctctcaacatccttgccctgtcaccccctgcccaaaatttgctacttaaatcgtacttctctgaagaaggtgaggaggaaggggacaagatgacatagagccattgaaacttttc

SEQ ID NO: 5089 - DNA, 170 bp, Homo sapiens
tgctactgaccctgcagccagaacagaagttccagaaagtgaagggatttggaggggccatgacagatgctgctgctctcaacatccttgccctgtcaccccctgcccaaaatttgctacttaaatcgtacttctctgaagaaggtgaggaggaaggggacaagatgaca

SEQ ID NO: 5090 - DNA, 170 bp, Homo sapiens
ttccctgtggatgtcctcaggcctgctactgaccctgcagccagaacagaagttccagaaagtgaagggatttggaggggccatgacagatgctgctgctctcaacatccttgccctgtcaccccctgcccaaaatttgctacttaaatcgtacttctctgaagaaggtg

SEQ ID NO: 5091 - DNA, 170 bp, Homo sapiens
gagtttcccgctgggtactgatacccttattccctgtggatgtcctcaggcctgctactgaccctgcagccagaacagaagttccagaaagtgaagggatttggaggggccatgacagatgctgctgctctcaacatccttgccctgtcaccccctgcccaaaatttgct

SEQ ID NO: 5092 - DNA, 170 bp, Homo sapiens
ggtaaatggtgtcagtgatcaccatggagtttcccgctgggtactgatacccttattccctgtggatgtcctcaggcctgctactgaccctgcagccagaacagaagttccagaaagtgaagggatttggaggggccatgacagatgctgctgctctcaacatccttgcc

SEQ ID NO: 5093 - DNA, 170 bp, Homo sapiens
gccaggctgggtcctcctagaggtaaatggtgtcagtgatcaccatggagtttcccgctgggtactgatacccttattccctgtggatgtcctcaggcctgctactgaccctgcagccagaacagaagttccagaaagtgaagggatttggaggggccatgacagatgct

SEQ ID NO: 5094 - DNA, 170 bp, Homo sapiens
ttcagcctcccagaggaagataccaagctcaaggtaggcattctagctttttcaggccctgagggccctgatgtctgggggttgagaaactgtagggtaggtctgcttgtacagacattttgtcccctgctgttttgtcctgggggtgggagggtggaggctaatggctg

SEQ ID NO: 5095 - DNA, 170 bp, Homo sapiens
cccctgatgatttccagttgcacaacttcagcctcccagaggaagataccaagctcaaggtaggcattctagctttttcaggccctgagggccctgatgtctgggggttgagaaactgtagggtaggtctgcttgtacagacattttgtcccctgctgttttgtcctggg

SEQ ID NO: 5096 - DNA, 170 bp, Homo sapiens
ccgcacctacacctatgcagacacccctgatgatttccagttgcacaacttcagcctcccagaggaagataccaagctcaaggtaggcattctagctttttcaggccctgagggccctgatgtctgggggttgagaaactgtagggtaggtctgcttgtacagacatttt

SEQ ID NO: 5097 - DNA, 170 bp, Homo sapiens
ccatggccagctgtgacttctccatccgcacctacacctatgcagacacccctgatgatttccagttgcacaacttcagcctcccagaggaagataccaagctcaaggtaggcattctagctttttcaggccctgagggccctgatgtctgggggttgagaaactgtagg

SEQ ID NO: 5098 - DNA, 170 bp, Homo sapiens
aggaatcggatataacatcatccgggtacccatggccagctgtgacttctccatccgcacctacacctatgcagacacccctgatgatttccagttgcacaacttcagcctcccagaggaagataccaagctcaaggtaggcattctagctttttcaggccctgagggcc

SEQ ID NO: 5099 - DNA, 170 bp, Homo sapiens
accatatcttgatcatccttttctgtaggaatcggatataacatcatccgggtacccatggccagctgtgacttctccatccgcacctacacctatgcagacacccctgatgatttccagttgcacaacttcagcctcccagaggaagataccaagctcaaggtaggcat

SEQ ID NO: 5100 - DNA, 170 bp, Homo sapiens
actctcctattgactcggactaccatatcttgatcatccttttctgtaggaatcggatataacatcatccgggtacccatggccagctgtgacttctccatccgcacctacacctatgcagacacccctgatgatttccagttgcacaacttcagcctcccagaggaaga

SEQ ID NO: 5101 - DNA, 170 bp, Homo sapiens
tggcaagtgataagcagagtcccatactctcctattgactcggactaccatatcttgatcatccttttctgtaggaatcggatataacatcatccgggtacccatggccagctgtgacttctccatccgcacctacacctatgcagacacccctgatgatttccagttgc

SEQ ID NO: 5102 - DNA, 170 bp, Homo sapiens
ggccctgactcagacactattaggactggcaagtgataagcagagtcccatactctcctattgactcggactaccatatcttgatcatccttttctgtaggaatcggatataacatcatccgggtacccatggccagctgtgacttctccatccgcacctacacctatgc

SEQ ID NO: 5103 - DNA, 170 bp, Homo sapiens
caacccaggagcccaagttccctttggccctgactcagacactattaggactggcaagtgataagcagagtcccatactctcctattgactcggactaccatatcttgatcatccttttctgtaggaatcggatataacatcatccgggtacccatggccagctgtgact

SEQ ID NO: 5104 - DNA, 170 bp, Homo sapiens
accagacctgggccagatactttgtgaagtaagggatcagcaaggatgtgggatcaggactggcctcccatttagccatgctgatctgtgtcccaaccctcaacctagttccacttccagatctgcctgtcctcagctcacctttctaccttctgggcctttcagccttg

SEQ ID NO: 5105 - DNA, 170 bp, Homo sapiens
gggacagcccggagacatctaccaccagacctgggccagatactttgtgaagtaagggatcagcaaggatgtgggatcaggactggcctcccatttagccatgctgatctgtgtcccaaccctcaacctagttccacttccagatctgcctgtcctcagctcacctttct

SEQ ID NO: 5106 - DNA, 170 bp, Homo sapiens
ctgggggtgggagggtggaggctaatggctgaaccggatgcactggttgggctagtatgtgttccaactctgggtgcttctctcttcactacctttgtctctagatacccctgattcaccgagccctgcagttggcccagcgtcccgtttcactccttgccagcccctgg

SEQ ID NO: 5107 - DNA, 170 bp, Homo sapiens
acagacattttgtcccctgctgttttgtcctgggggtgggagggtggaggctaatggctgaaccggatgcactggttgggctagtatgtgttccaactctgggtgcttctctcttcactacctttgtctctagatacccctgattcaccgagccctgcagttggcccagc

SEQ ID NO: 5108 - DNA, 170 bp, Homo sapiens
gcggtgaatgggaaggggtcactcaagggacagcccggagacatctaccaccagacctgggccagatactttgtgaagtaagggatcagcaaggatgtgggatcaggactggcctcccatttagccatgctgatctgtgtcccaaccctcaacctagttccacttccaga

SEQ ID NO: 5109 - DNA, 170 bp, Homo sapiens
cacccacttggctcaagaccaatggagcggtgaatgggaaggggtcactcaagggacagcccggagacatctaccaccagacctgggccagatactttgtgaagtaagggatcagcaaggatgtgggatcaggactggcctcccatttagccatgctgatctgtgtccca

SEQ ID NO: 5110 - DNA, 170 bp, Homo sapiens
cactccttgccagcccctggacatcacccacttggctcaagaccaatggagcggtgaatgggaaggggtcactcaagggacagcccggagacatctaccaccagacctgggccagatactttgtgaagtaagggatcagcaaggatgtgggatcaggactggcctcccat

SEQ ID NO: 5111 - DNA, 170 bp, Homo sapiens
gcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagtaagggatcagcaaggatg

SEQ ID NO: 5112 - DNA, 170 bp, Homo sapiens
tgtctctagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccag

SEQ ID NO: 5113 - DNA, 170 bp, Homo sapiens
gggtgcttctctcttcactacctttgtctctagatacccctgattcaccgagccctgcagttggcccagcgtcccgtttcactccttgccagcccctggacatcacccacttggctcaagaccaatggagcggtgaatgggaaggggtcactcaagggacagcccggaga

SEQ ID NO: 5114 - DNA, 170 bp, Homo sapiens
tgggctagtatgtgttccaactctgggtgcttctctcttcactacctttgtctctagatacccctgattcaccgagccctgcagttggcccagcgtcccgtttcactccttgccagcccctggacatcacccacttggctcaagaccaatggagcggtgaatgggaaggg

SEQ ID NO: 5115 - DNA, 170 bp, Homo sapiens
tggctgaaccggatgcactggttgggctagtatgtgttccaactctgggtgcttctctcttcactacctttgtctctagatacccctgattcaccgagccctgcagttggcccagcgtcccgtttcactccttgccagcccctggacatcacccacttggctcaagacca

SEQ ID NO: 5116 - DNA, 170 bp, Homo sapiens
tgccccactgggcaaaggtggtaaggcctggacctccatggtgctccagtgaccttcaaatccagcatccaaatgactggctcccaaacttagagcgatttctctacccaactatggattcctagagcaccattcccctggacctccagggtgccatggatcccacagtt

SEQ ID NO: 5117 - DNA, 170 bp, Homo sapiens
atgctggatgaccaacgcttgctgctgccccactgggcaaaggtggtaaggcctggacctccatggtgctccagtgaccttcaaatccagcatccaaatgactggctcccaaacttagagcgatttctctacccaactatggattcctagagcaccattcccctggacct

SEQ ID NO: 5118 - DNA, 170 bp, Homo sapiens
ggccggatcattcatgacctttctcttgccaggttcctggatgcctatgctgagcacaagttacagttctgggcagtgacagctgaaaatgagccttctgctgggctgttgagtggataccccttccagtgcctgggcttcacccctgaacatcagcgagacttcattgc

SEQ ID NO: 5119 - DNA, 170 bp, Homo sapiens
cccagctggtctggtccactttcttggccggatcattcatgacctttctcttgccaggttcctggatgcctatgctgagcacaagttacagttctgggcagtgacagctgaaaatgagccttctgctgggctgttgagtggataccccttccagtgcctgggcttcaccc

SEQ ID NO: 5120 - DNA, 170 bp, Homo sapiens
ctgggattacaggtgtgagccaccacacccagctggtctggtccactttcttggccggatcattcatgacctttctcttgccaggttcctggatgcctatgctgagcacaagttacagttctgggcagtgacagctgaaaatgagccttctgctgggctgttgagtggat

SEQ ID NO: 5121 - DNA, 170 bp, Homo sapiens
cctgcctcggcttcccaaagtgctgggattacaggtgtgagccaccacacccagctggtctggtccactttcttggccggatcattcatgacctttctcttgccaggttcctggatgcctatgctgagcacaagttacagttctgggcagtgacagctgaaaatgagcct

SEQ ID NO: 5122 - DNA, 170 bp, Homo sapiens
tcgaactcctgaactcaagtgatccacctgcctcggcttcccaaagtgctgggattacaggtgtgagccaccacacccagctggtctggtccactttcttggccggatcattcatgacctttctcttgccaggttcctggatgcctatgctgagcacaagttacagttct

SEQ ID NO: 5123 - DNA, 170 bp, Homo sapiens
actcaccacaatgtccgcctactcatgctggatgaccaacgcttgctgctgccccactgggcaaaggtggtaaggcctggacctccatggtgctccagtgaccttcaaatccagcatccaaatgactggctcccaaacttagagcgatttctctacccaactatggattc

SEQ ID NO: 5124 - DNA, 170 bp, Homo sapiens
cctaggtcctaccctcgccaacagtactcaccacaatgtccgcctactcatgctggatgaccaacgcttgctgctgccccactgggcaaaggtggtaaggcctggacctccatggtgctccagtgaccttcaaatccagcatccaaatgactggctcccaaacttagagc

SEQ ID NO: 5125 - DNA, 170 bp, Homo sapiens
catcagcgagacttcattgcccgtgacctaggtcctaccctcgccaacagtactcaccacaatgtccgcctactcatgctggatgaccaacgcttgctgctgccccactgggcaaaggtggtaaggcctggacctccatggtgctccagtgaccttcaaatccagcatcc

SEQ ID NO: 5126 - DNA, 170 bp, Homo sapiens
ccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtaaggcctggacctccatggtgct

SEQ ID NO: 5127 - DNA, 170 bp, Homo sapiens
tgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaagg

SEQ ID NO: 5128 - DNA, 170 bp, Homo sapiens
agtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgct

SEQ ID NO: 5129 - DNA, 170 bp, Homo sapiens
tgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcc

SEQ ID NO: 5130 - DNA, 170 bp, Homo sapiens
tctcttgccaggttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccct

SEQ ID NO: 5131 - DNA, 170 bp, Homo sapiens
acagccacagcatcatcacggtaagccaccccagtctcccttcctgcaaagcagacctcagacctcttactagtttcaccaaagactgacagaagcccttcctgtccagctttccccagctagcctgcccttttgagcaactctggggaaccatgattccctatcttccc

SEQ ID NO: 5132 - DNA, 170 bp, Homo sapiens
ggctcctgggatcgagggatgcagtacagccacagcatcatcacggtaagccaccccagtctcccttcctgcaaagcagacctcagacctcttactagtttcaccaaagactgacagaagcccttcctgtccagctttccccagctagcctgcccttttgagcaactctg

SEQ ID NO: 5133 - DNA, 170 bp, Homo sapiens
agaagcctgtgtgcaaggtccaggatcagttgctcttcctttgcaggtactgacagacccagaagcagctaaatatgttcatggcattgctgtacattggtacctggactttctggctccagccaaagccaccctaggggagacacaccgcctgttccccaacaccatgc

SEQ ID NO: 5134 - DNA, 170 bp, Homo sapiens
caggattcctacaacaggaactagaagttccagaagcctgtgtgcaaggtccaggatcagttgctcttcctttgcaggtactgacagacccagaagcagctaaatatgttcatggcattgctgtacattggtacctggactttctggctccagccaaagccaccctaggg

SEQ ID NO: 5135 - DNA, 170 bp, Homo sapiens
cttcccgtcacccaactccaggattcctacaacaggaactagaagttccagaagcctgtgtgcaaggtccaggatcagttgctcttcctttgcaggtactgacagacccagaagcagctaaatatgttcatggcattgctgtacattggtacctggactttctggctcca

SEQ ID NO: 5136 - DNA, 170 bp, Homo sapiens
tctccccaaacctctctagttgcattcttcccgtcacccaactccaggattcctacaacaggaactagaagttccagaagcctgtgtgcaaggtccaggatcagttgctcttcctttgcaggtactgacagacccagaagcagctaaatatgttcatggcattgctgtac

SEQ ID NO: 5137 - DNA, 170 bp, Homo sapiens
catcctgtctcaaaaacaaaaaaaaatctccccaaacctctctagttgcattcttcccgtcacccaactccaggattcctacaacaggaactagaagttccagaagcctgtgtgcaaggtccaggatcagttgctcttcctttgcaggtactgacagacccagaagcagc

SEQ ID NO: 5138 - DNA, 170 bp, Homo sapiens
agttctgggagcagagtgtgcggctaggctcctgggatcgagggatgcagtacagccacagcatcatcacggtaagccaccccagtctcccttcctgcaaagcagacctcagacctcttactagtttcaccaaagactgacagaagcccttcctgtccagctttccccag

SEQ ID NO: 5139 - DNA, 170 bp, Homo sapiens
tcagaggcctgtgtgggctccaagttctgggagcagagtgtgcggctaggctcctgggatcgagggatgcagtacagccacagcatcatcacggtaagccaccccagtctcccttcctgcaaagcagacctcagacctcttactagtttcaccaaagactgacagaagcc

SEQ ID NO: 5140 - DNA, 170 bp, Homo sapiens
cctgttccccaacaccatgctctttgcctcagaggcctgtgtgggctccaagttctgggagcagagtgtgcggctaggctcctgggatcgagggatgcagtacagccacagcatcatcacggtaagccaccccagtctcccttcctgcaaagcagacctcagacctctta

SEQ ID NO: 5141 - DNA, 170 bp, Homo sapiens
aagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacggtaagccaccccagtctcccttcc

SEQ ID NO: 5142 - DNA, 170 bp, Homo sapiens
gtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatca

SEQ ID NO: 5143 - DNA, 170 bp, Homo sapiens
atgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgaggg

SEQ ID NO: 5144 - DNA, 170 bp, Homo sapiens
gacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgc

SEQ ID NO: 5145 - DNA, 170 bp, Homo sapiens
ggatcagttgctcttcctttgcaggtactgacagacccagaagcagctaaatatgttcatggcattgctgtacattggtacctggactttctggctccagccaaagccaccctaggggagacacaccgcctgttccccaacaccatgctctttgcctcagaggcctgtgt

SEQ ID NO: 5146 - DNA, 170 bp, Homo sapiens
gcccatgttctaccaccttggccacttcaggtgagtggagggcgggcacccccattccataccaggcctatcatctcctacatcggatggcttacatcactctacaccacgagggagcaggaaggtgttcagggtggaacctcggaagaggcacacccatccccttttgc

SEQ ID NO: 5147 - DNA, 170 bp, Homo sapiens
acacgttttacaaacagcccatgttctaccaccttggccacttcaggtgagtggagggcgggcacccccattccataccaggcctatcatctcctacatcggatggcttacatcactctacaccacgagggagcaggaaggtgttcagggtggaacctcggaagaggcac

SEQ ID NO: 5148 - DNA, 170 bp, Homo sapiens
cacagggctgacctacccacagctgcctctcccacatgtgacccttacctacactctctggggacccccagtgttgcgcctttgtctctttgcctttgtccttaccctagaacctcctgtaccatgtggtcggctggaccgactggaaccttgccctgaaccccgaagga

SEQ ID NO: 5149 - DNA, 170 bp, Homo sapiens
actccttagctactaaggaatgtgcccctcacagggctgacctacccacagctgcctctcccacatgtgacccttacctacactctctggggacccccagtgttgcgcctttgtctctttgcctttgtccttaccctagaacctcctgtaccatgtggtcggctggaccg

SEQ ID NO: 5150 - DNA, 170 bp, Homo sapiens
cgacagtcccatcattgtagacatcaccaaggacacgttttacaaacagcccatgttctaccaccttggccacttcaggtgagtggagggcgggcacccccattccataccaggcctatcatctcctacatcggatggcttacatcactctacaccacgagggagcagga

SEQ ID NO: 5151 - DNA, 170 bp, Homo sapiens
ccaattgggtgcgtaactttgtcgacagtcccatcattgtagacatcaccaaggacacgttttacaaacagcccatgttctaccaccttggccacttcaggtgagtggagggcgggcacccccattccataccaggcctatcatctcctacatcggatggcttacatcac

SEQ ID NO: 5152 - DNA, 170 bp, Homo sapiens
gccctgaaccccgaaggaggacccaattgggtgcgtaactttgtcgacagtcccatcattgtagacatcaccaaggacacgttttacaaacagcccatgttctaccaccttggccacttcaggtgagtggagggcgggcacccccattccataccaggcctatcatctcc

SEQ ID NO: 5153 - DNA, 170 bp, Homo sapiens
atgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcaggtgagtggagggcgggcac

SEQ ID NO: 5154 - DNA, 170 bp, Homo sapiens
tccttaccctagaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggcca

SEQ ID NO: 5155 - DNA, 170 bp, Homo sapiens
gcctttgtctctttgcctttgtccttaccctagaacctcctgtaccatgtggtcggctggaccgactggaaccttgccctgaaccccgaaggaggacccaattgggtgcgtaactttgtcgacagtcccatcattgtagacatcaccaaggacacgttttacaaacagcc

SEQ ID NO: 5156 - DNA, 170 bp, Homo sapiens
tctctggggacccccagtgttgcgcctttgtctctttgcctttgtccttaccctagaacctcctgtaccatgtggtcggctggaccgactggaaccttgccctgaaccccgaaggaggacccaattgggtgcgtaactttgtcgacagtcccatcattgtagacatcacc

SEQ ID NO: 5157 - DNA, 170 bp, Homo sapiens
tctcccacatgtgacccttacctacactctctggggacccccagtgttgcgcctttgtctctttgcctttgtccttaccctagaacctcctgtaccatgtggtcggctggaccgactggaaccttgccctgaaccccgaaggaggacccaattgggtgcgtaactttgtc

SEQ ID NO: 5158 - DNA, 170 bp, Homo sapiens; identical to SEQ ID NO: 4640

SEQ ID NO: 5159 - DNA, 170 bp, Homo sapiens
tgccgttactgccctgtggggcaaggtgaacgtggatgaagttggtggtgaggccctgggcaggttggtatcaaggttacaagacaggtttaaggagaccaatagaaactgggcatgtggagacagagaagactcttgggtttctgataggcactgactctctctgccta

SEQ ID NO: 5160 - DNA, 170 bp, Homo sapiens
tgcatctgactcctgaggagaagtctgccgttactgccctgtggggcaaggtgaacgtggatgaagttggtggtgaggccctgggcaggttggtatcaaggttacaagacaggtttaaggagaccaatagaaactgggcatgtggagacagagaagactcttgggtttct

SEQ ID NO: 5161 - DNA, 170 bp, Homo sapiens
ttcactagcaacctcaaacagacaccatggtgcatctgactcctgaggagaagtctgccgttactgccctgtggggcaaggtgaacgtggatgaagttggtggtgaggccctgggcaggttggtatcaaggttacaagacaggtttaaggagaccaatagaaactgggca

SEQ ID NO: 5162 - DNA, 170 bp, Homo sapiens
catttgcttctgacacaactgtgttcactagcaacctcaaacagacaccatggtgcatctgactcctgaggagaagtctgccgttactgccctgtggggcaaggtgaacgtggatgaagttggtggtgaggccctgggcaggttggtatcaaggttacaagacaggttta

SEQ ID NO: 5163 - DNA, 170 bp, Homo sapiens
aaagtcagggcagagccatctattgcttacatttgcttctgacacaactgtgttcactagcaacctcaaacagacaccatggtgcatctgactcctgaggagaagtctgccgttactgccctgtggggcaaggtgaacgtggatgaagttggtggtgaggccctgggcag

SEQ ID NO: 5164 - DNA, 170 bp, Homo sapiens
gagggcaggagccagggctgggcataaaagtcagggcagagccatctattgcttacatttgcttctgacacaactgtgttcactagcaacctcaaacagacaccatggtgcatctgactcctgaggagaagtctgccgttactgccctgtggggcaaggtgaacgtggat

SEQ ID NO: 5165 - DNA, 170 bp, Homo sapiens
ttggccaatctactcccaggagcagggagggcaggagccagggctgggcataaaagtcagggcagagccatctattgcttacatttgcttctgacacaactgtgttcactagcaacctcaaacagacaccatggtgcatctgactcctgaggagaagtctgccgttactg

SEQ ID NO: 5166 - DNA, 170 bp, Homo sapiens
gtggatcctgagaacttcagggtgagtctatgggacgcttgatgttttctttccccttcttttctatggttaagttcatgtcataggaaggggataagtaacagggtacagtttagaatgggaaacagacgaatgattgcatcagtgtggaagtctcaggatcgttttag

SEQ ID NO: 5167 - DNA, 170 bp, Homo sapiens
gctgcactgtgacaagctgcacgtggatcctgagaacttcagggtgagtctatgggacgcttgatgttttctttccccttcttttctatggttaagttcatgtcataggaaggggataagtaacagggtacagtttagaatgggaaacagacgaatgattgcatcagtgt

SEQ ID NO: 5168 - DNA, 170 bp, Homo sapiens; identical to SEQ ID NO: 4635

SEQ ID NO: 5169 - DNA, 170 bp, Homo sapiens; identical to SEQ ID NO: 4636

SEQ ID NO: 5170 - DNA, 170 bp, Homo sapiens; identical to SEQ ID NO: 4637

SEQ ID NO: 5171 - DNA, 170 bp, Homo sapiens; identical to SEQ ID NO: 4638

SEQ ID NO: 5172 - DNA, 170 bp, Homo sapiens
agggcacctttgccacactgagtgagctgcactgtgacaagctgcacgtggatcctgagaacttcagggtgagtctatgggacgcttgatgttttctttccccttcttttctatggttaagttcatgtcataggaaggggataagtaacagggtacagtttagaatggga

SEQ ID NO: 5173 - DNA, 170 bp, Homo sapiens
tggcctggctcacctggacaacctcaagggcacctttgccacactgagtgagctgcactgtgacaagctgcacgtggatcctgagaacttcagggtgagtctatgggacgcttgatgttttctttccccttcttttctatggttaagttcatgtcataggaaggggataa

SEQ ID NO: 5174 - DNA, 170 bp, Homo sapiens
gaaagtgctcggtgcctttagtgatggcctggctcacctggacaacctcaagggcacctttgccacactgagtgagctgcactgtgacaagctgcacgtggatcctgagaacttcagggtgagtctatgggacgcttgatgttttctttccccttcttttctatggttaa

SEQ ID NO: 5175 - DNA, 170 bp, Homo sapiens
accctaaggtgaaggctcatggcaagaaagtgctcggtgcctttagtgatggcctggctcacctggacaacctcaagggcacctttgccacactgagtgagctgcactgtgacaagctgcacgtggatcctgagaacttcagggtgagtctatgggacgcttgatgtttt

SEQ ID NO: 5176 - DNA, 170 bp, Homo sapiens
tggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgaga

SEQ ID NO: 5177 - DNA, 170 bp, Homo sapiens
ggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgt

SEQ ID NO: 5178 - DNA, 170 bp, Homo sapiens; identical to SEQ ID NO: 4633

SEQ ID NO: 5179 - DNA, 170 bp, Homo sapiens; identical to SEQ ID NO: 4634

SEQ ID NO: 5180 - DNA, 170 bp, Homo sapiens
ccctggcccacaagtatcactaagctcgctttcttgctgtccaatttctattaaaggttcctttgttccctaagtccaactactaaactgggggatattatgaagggccttgagcatctggattctgcctaataaaaaacatttattttcattgcaatgatgtatttaaa

SEQ ID NO: 5181 - DNA, 170 bp, Homo sapiens
aaagtggtggctggtgtggctaatgccctggcccacaagtatcactaagctcgctttcttgctgtccaatttctattaaaggttcctttgttccctaagtccaactactaaactgggggatattatgaagggccttgagcatctggattctgcctaataaaaaacattta

SEQ ID NO: 5182 - DNA, 170 bp, Homo sapiens
cccaccagtgcaggctgcctatcagaaagtggtggctggtgtggctaatgccctggcccacaagtatcactaagctcgctttcttgctgtccaatttctattaaaggttcctttgttccctaagtccaactactaaactgggggatattatgaagggccttgagcatctg

SEQ ID NO: 5183 - DNA, 170 bp, Homo sapiens
cccatcactttggcaaagaattcaccccaccagtgcaggctgcctatcagaaagtggtggctggtgtggctaatgccctggcccacaagtatcactaagctcgctttcttgctgtccaatttctattaaaggttcctttgttccctaagtccaactactaaactggggga

SEQ ID NO: 5184 - DNA, 170 bp, Homo sapiens
ggcaacgtgctggtctgtgtgctggcccatcactttggcaaagaattcaccccaccagtgcaggctgcctatcagaaagtggtggctggtgtggctaatgccctggcccacaagtatcactaagctcgctttcttgctgtccaatttctattaaaggttcctttgttccc

SEQ ID NO: 5185 - DNA, 170 bp, Homo sapiens
acctcttatcttcctcccacagctcctgggcaacgtgctggtctgtgtgctggcccatcactttggcaaagaattcaccccaccagtgcaggctgcctatcagaaagtggtggctggtgtggctaatgccctggcccacaagtatcactaagctcgctttcttgctgtcc

SEQ ID NO: 5186 - DNA, 170 bp, Homo sapiens
ccaagctaggcccttttgctaatcatgttcatacctcttatcttcctcccacagctcctgggcaacgtgctggtctgtgtgctggcccatcactttggcaaagaattcaccccaccagtgcaggctgcctatcagaaagtggtggctggtgtggctaatgccctggccca

SEQ ID NO: 5187 - DNA, 170 bp, Homo sapiens
gggataaggctggattattctgagtccaagctaggcccttttgctaatcatgttcatacctcttatcttcctcccacagctcctgggcaacgtgctggtctgtgtgctggcccatcactttggcaaagaattcaccccaccagtgcaggctgcctatcagaaagtggtgg

SEQ ID NO: 5188 - DNA, 170 bp, Homo sapiens
accattctgcttttattttatggttgggataaggctggattattctgagtccaagctaggcccttttgctaatcatgttcatacctcttatcttcctcccacagctcctgggcaacgtgctggtctgtgtgctggcccatcactttggcaaagaattcaccccaccagtg

SEQ ID NO: 5189 - DNA, 170 bp, Homo sapiens
ctaatagcagctacaatccagctaccattctgcttttattttatggttgggataaggctggattattctgagtccaagctaggcccttttgctaatcatgttcatacctcttatcttcctcccacagctcctgggcaacgtgctggtctgtgtgctggcccatcactttg

SEQ ID NO: 5190 - DNA, 170 bp, Homo sapiens
gcttttcggttccgggtcttggccccgtccttacctcacaggtgagtcggacttgtcccgccctgttcctgggccctgagagtgcctgcctggggacagttcccccagggctccagagacgccctatgggcttttgtccagccctctgatcacaggcactccacttcctc

SEQ ID NO: 5191 - DNA, 170 bp, Homo sapiens
gccttccagcgctatcgtgacctgcttttcggttccgggtcttggccccgtccttacctcacaggtgagtcggacttgtcccgccctgttcctgggccctgagagtgcctgcctggggacagttcccccagggctccagagacgccctatgggcttttgtccagccctct

SEQ ID NO: 5192 - DNA, 170 bp, Homo sapiens
ccagccccctccgagaggggagaccagcgggccatgacaagctccaggctttggttttcgctgctgctggcggcagcgttcgcaggacgggcgacggccctctggccctggcctcagaacttccaaacctccgaccagcgctacgtcctttacccgaacaactttcaatt

SEQ ID NO: 5193 - DNA, 170 bp, Homo sapiens
cgctcacctgaccagggtctcacgtggccagccccctccgagaggggagaccagcgggccatgacaagctccaggctttggttttcgctgctgctggcggcagcgttcgcaggacgggcgacggccctctggccctggcctcagaacttccaaacctccgaccagcgcta

SEQ ID NO: 5194 - DNA, 170 bp, Homo sapiens
acgtgattcgccgataagtcacgggggcgccgctcacctgaccagggtctcacgtggccagccccctccgagaggggagaccagcgggccatgacaagctccaggctttggttttcgctgctgctggcggcagcgttcgcaggacgggcgacggccctctggccctggcc

SEQ ID NO: 5195 - DNA, 170 bp, Homo sapiens
caggcgcagagccgcctctggtcacgtgattcgccgataagtcacgggggcgccgctcacctgaccagggtctcacgtggccagccccctccgagaggggagaccagcgggccatgacaagctccaggctttggttttcgctgctgctggcggcagcgttcgcaggacgg

SEQ ID NO: 5196 - DNA, 170 bp, Homo sapiens
ggtgtgggtcctcctggggtcgcaggcgcagagccgcctctggtcacgtgattcgccgataagtcacgggggcgccgctcacctgaccagggtctcacgtggccagccccctccgagaggggagaccagcgggccatgacaagctccaggctttggttttcgctgctgct

SEQ ID NO: 5197 - DNA, 170 bp, Homo sapiens
agcccggctgctcagtcctcgacgaggccttccagcgctatcgtgacctgcttttcggttccgggtcttggccccgtccttacctcacaggtgagtcggacttgtcccgccctgttcctgggccctgagagtgcctgcctggggacagttcccccagggctccagagacg

SEQ ID NO: 5198 - DNA, 170 bp, Homo sapiens
cagtacgatgtcagctcggccgcgcagcccggctgctcagtcctcgacgaggccttccagcgctatcgtgacctgcttttcggttccgggtcttggccccgtccttacctcacaggtgagtcggacttgtcccgccctgttcctgggccctgagagtgcctgcctgggga

SEQ ID NO: 5199 - DNA, 170 bp, Homo sapiens
gtcctttacccgaacaactttcaattccagtacgatgtcagctcggccgcgcagcccggctgctcagtcctcgacgaggccttccagcgctatcgtgacctgcttttcggttccgggtcttggccccgtccttacctcacaggtgagtcggacttgtcccgccctgttcc

SEQ ID NO: 5200 - DNA, 170 bp, Homo sapiens
aacctccgaccagcgctacgtcctttacccgaacaactttcaattccagtacgatgtcagctcggccgcgcagcccggctgctcagtcctcgacgaggccttccagcgctatcgtgacctgcttttcggttccgggtcttggccccgtccttacctcacaggtgagtcgg

SEQ ID NO: 5201 - DNA, 170 bp, Homo sapiens
ctctggccctggcctcagaacttccaaacctccgaccagcgctacgtcctttacccgaacaactttcaattccagtacgatgtcagctcggccgcgcagcccggctgctcagtcctcgacgaggccttccagcgctatcgtgacctgcttttcggttccgggtcttggcc

SEQ ID NO: 5202 - DNA, 170 bp, Homo sapiens
cagcgttcgcaggacgggcgacggccctctggccctggcctcagaacttccaaacctccgaccagcgctacgtcctttacccgaacaactttcaattccagtacgatgtcagctcggccgcgcagcccggctgctcagtcctcgacgaggccttccagcgctatcgtgac

SEQ ID NO: 5203 - DNA, 170 bp, Homo sapiens
aggctttggttttcgctgctgctggcggcagcgttcgcaggacgggcgacggccctctggccctggcctcagaacttccaaacctccgaccagcgctacgtcctttacccgaacaactttcaattccagtacgatgtcagctcggccgcgcagcccggctgctcagtcct

SEQ ID NO: 5204 - DNA, 170 bp, Homo sapiens
ccagcgggccatgacaagctccaggctttggttttcgctgctgctggcggcagcgttcgcaggacgggcgacggccctctggccctggcctcagaacttccaaacctccgaccagcgctacgtcctttacccgaacaactttcaattccagtacgatgtcagctcggccg

SEQ ID NO: 5205 - DNA, 170 bp, Homo sapiens
ggctatgtggtgtggcaggaggtgtttgataataaagtaaaggtgagccggggcagagaagagaagaagccaccagcagtgcctccctctggtctccccagctcctccctgcctctacagagactgatcctcctggtttggattgggctttaatggtcggagcactctcc

SEQ ID NO: 5206 - DNA, 170 bp, Homo sapiens
gctggacatcgtctcttcttatggcaagggctatgtggtgtggcaggaggtgtttgataataaagtaaaggtgagccggggcagagaagagaagaagccaccagcagtgcctccctctggtctccccagctcctccctgcctctacagagactgatcctcctggtttgga

SEQ ID NO: 5207 - DNA, 170 bp, Homo sapiens
actagacactcctctcctctccaggctgctggacatcgtctcttcttatggcaagggctatgtggtgtggcaggaggtgtttgataataaagtaaaggtgagccggggcagagaagagaagaagccaccagcagtgcctccctctggtctccccagctcctccctgcctc

SEQ ID NO: 5208 - DNA, 170 bp, Homo sapiens
tgagctaagcagacacttactagacactcctctcctctccaggctgctggacatcgtctcttcttatggcaagggctatgtggtgtggcaggaggtgtttgataataaagtaaaggtgagccggggcagagaagagaagaagccaccagcagtgcctccctctggtctcc

SEQ ID NO: 5209 - DNA, 170 bp, Homo sapiens
agcactggcacaaacagtctagaacccatctgagctaagcagacacttactagacactcctctcctctccaggctgctggacatcgtctcttcttatggcaagggctatgtggtgtggcaggaggtgtttgataataaagtaaaggtgagccggggcagagaagagaaga

SEQ ID NO: 5210 - DNA, 170 bp, Homo sapiens
tggccaggctcaacccctagagcactggcacaaacagtctagaacccatctgagctaagcagacacttactagacactcctctcctctccaggctgctggacatcgtctcttcttatggcaagggctatgtggtgtggcaggaggtgtttgataataaagtaaaggtgag

SEQ ID NO: 5211 - DNA, 170 bp, Homo sapiens
gaaagacactgcttaatgaggaataggcccctggccaggctcaacccctagagcactggcacaaacagtctagaacccatctgagctaagcagacacttactagacactcctctcctctccaggctgctggacatcgtctcttcttatggcaagggctatgtggtgtggc

SEQ ID NO: 5212 - DNA, 170 bp, Homo sapiens
gagtggttggttttcagcccaggggaaagacactgcttaatgaggaataggcccctggccaggctcaacccctagagcactggcacaaacagtctagaacccatctgagctaagcagacacttactagacactcctctcctctccaggctgctggacatcgtctcttctt

SEQ ID NO: 5213 - DNA, 170 bp, Homo sapiens
tggaacccctggcatttgaaggtgaaagcagagagctctccttgctaaccaaaggaggctgggttggggcacaggatgggaggcaggaaggtctgggccagacatttccagttagtaaatgaaacaacttagctggggtgagggccacattgggaaggtggttgagaggg

SEQ ID NO: 5214 - DNA, 170 bp, Homo sapiens
ccctgactggaaggatttctacatagtggaacccctggcatttgaaggtgaaagcagagagctctccttgctaaccaaaggaggctgggttggggcacaggatgggaggcaggaaggtctgggccagacatttccagttagtaaatgaaacaacttagctggggtgaggg

SEQ ID NO: 5215 - DNA, 170 bp, Homo sapiens
tgttgtcccatgttgcctgtgtatgaataaggcccaggaatctcctcagctttgtgtccttactgccatttgaccttttataacagattcagccagacacaatcatacaggtgtggcgagaggatattccagtgaactatatgaaggagctggaactggtcaccaaggcc

SEQ ID NO: 5216 - DNA, 170 bp, Homo sapiens
gggaacagagggagcacatacctgttgtcccatgttgcctgtgtatgaataaggcccaggaatctcctcagctttgtgtccttactgccatttgaccttttataacagattcagccagacacaatcatacaggtgtggcgagaggatattccagtgaactatatgaagga

SEQ ID NO: 5217 - DNA, 170 bp, Homo sapiens
aggagtcacagagacatactttgctgctggggaacagagggagcacatacctgttgtcccatgttgcctgtgtatgaataaggcccaggaatctcctcagctttgtgtccttactgccatttgaccttttataacagattcagccagacacaatcatacaggtgtggcga

SEQ ID NO: 5218 - DNA, 170 bp, Homo sapiens
acctgaaccgtatatcctatggccctgactggaaggatttctacatagtggaacccctggcatttgaaggtgaaagcagagagctctccttgctaaccaaaggaggctgggttggggcacaggatgggaggcaggaaggtctgggccagacatttccagttagtaaatga

SEQ ID NO: 5219 - DNA, 170 bp, Homo sapiens
cgggcccttctctctgccccctggtacctgaaccgtatatcctatggccctgactggaaggatttctacatagtggaacccctggcatttgaaggtgaaagcagagagctctccttgctaaccaaaggaggctgggttggggcacaggatgggaggcaggaaggtctggg

SEQ ID NO: 5220 - DNA, 170 bp, Homo sapiens
ctggaactggtcaccaaggccggcttccgggcccttctctctgccccctggtacctgaaccgtatatcctatggccctgactggaaggatttctacatagtggaacccctggcatttgaaggtgaaagcagagagctctccttgctaaccaaaggaggctgggttggggc

SEQ ID NO: 5221 - DNA, 170 bp, Homo sapiens
ggatattccagtgaactatatgaaggagctggaactggtcaccaaggccggcttccgggcccttctctctgccccctggtacctgaaccgtatatcctatggccctgactggaaggatttctacatagtggaacccctggcatttgaaggtgaaagcagagagctctcct

SEQ ID NO: 5222 - DNA, 170 bp, Homo sapiens
acaatcatacaggtgtggcgagaggatattccagtgaactatatgaaggagctggaactggtcaccaaggccggcttccgggcccttctctctgccccctggtacctgaaccgtatatcctatggccctgactggaaggatttctacatagtggaacccctggcatttga

SEQ ID NO: 5223 - DNA, 170 bp, Homo sapiens
ccttttataacagattcagccagacacaatcatacaggtgtggcgagaggatattccagtgaactatatgaaggagctggaactggtcaccaaggccggcttccgggcccttctctctgccccctggtacctgaaccgtatatcctatggccctgactggaaggatttct

SEQ ID NO: 5224 - DNA, 170 bp, Homo sapiens
ctttgtgtccttactgccatttgaccttttataacagattcagccagacacaatcatacaggtgtggcgagaggatattccagtgaactatatgaaggagctggaactggtcaccaaggccggcttccgggcccttctctctgccccctggtacctgaaccgtatatcct

SEQ ID NO: 5225 - DNA, 170 bp, Homo sapiens
tgaataaggcccaggaatctcctcagctttgtgtccttactgccatttgaccttttataacagattcagccagacacaatcatacaggtgtggcgagaggatattccagtgaactatatgaaggagctggaactggtcaccaaggccggcttccgggcccttctctctgc

SEQ ID NO: 5226 - DNA, 170 bp, Homo sapiens
ggggagaatatgtggacaacacaaacctggtccccaggctctggtaagggttttcgggggggaggtggagggttgggcctgagagcaggagttctcccttagagacccaatcccatctagccacctctggactagtacccttctttcaggcctgagagagagcaggccgt

SEQ ID NO: 5227 - DNA, 170 bp, Homo sapiens
tggtggagaggcttgtatgtggggagaatatgtggacaacacaaacctggtccccaggctctggtaagggttttcgggggggaggtggagggttgggcctgagagcaggagttctcccttagagacccaatcccatctagccacctctggactagtacccttctttcagg

SEQ ID NO: 5228 - DNA, 170 bp, Homo sapiens
cccctgagcagaaggctctggtgattggtggagaggcttgtatgtggggagaatatgtggacaacacaaacctggtccccaggctctggtaagggttttcgggggggaggtggagggttgggcctgagagcaggagttctcccttagagacccaatcccatctagccacc

SEQ ID NO: 5229 - DNA, 170 bp, Homo sapiens
actgttgttgcttgttttccctcaggtacccctgagcagaaggctctggtgattggtggagaggcttgtatgtggggagaatatgtggacaacacaaacctggtccccaggctctggtaagggttttcgggggggaggtggagggttgggcctgagagcaggagttctcc

SEQ ID NO: 5230 - DNA, 170 bp, Homo sapiens
agttaccccaccatcaccagactgttgttgcttgttttccctcaggtacccctgagcagaaggctctggtgattggtggagaggcttgtatgtggggagaatatgtggacaacacaaacctggtccccaggctctggtaagggttttcgggggggaggtggagggttggg

SEQ ID NO: 5231 - DNA, 170 bp, Homo sapiens
cacattgggaaggtggttgagagggaccctggagttaccccaccatcaccagactgttgttgcttgttttccctcaggtacccctgagcagaaggctctggtgattggtggagaggcttgtatgtggggagaatatgtggacaacacaaacctggtccccaggctctggt

SEQ ID NO: 5232 - DNA, 170 bp, Homo sapiens
acaacttagctggggtgagggccacattgggaaggtggttgagagggaccctggagttaccccaccatcaccagactgttgttgcttgttttccctcaggtacccctgagcagaaggctctggtgattggtggagaggcttgtatgtggggagaatatgtggacaacaca

SEQ ID NO: 5233 - DNA, 170 bp, Homo sapiens
gccagacatttccagttagtaaatgaaacaacttagctggggtgagggccacattgggaaggtggttgagagggaccctggagttaccccaccatcaccagactgttgttgcttgttttccctcaggtacccctgagcagaaggctctggtgattggtggagaggcttgt

SEQ ID NO: 5234 - DNA, 170 bp, Homo sapiens
atgaacgtttgtcacacttccgctgtgaattgctgaggtaagcaagctgtggggccttcgcaaggcggagcaggccagatccagggctggggaaccccttagagagaggaagacaataattaacaatagctaacacttacagaggcttatagtcagccctcatccacgga

SEQ ID NO: 5235 - DNA, 170 bp, Homo sapiens
tgacatctgacctgacatttgcctatgaacgtttgtcacacttccgctgtgaattgctgaggtaagcaagctgtggggccttcgcaaggcggagcaggccagatccagggctggggaaccccttagagagaggaagacaataattaacaatagctaacacttacagaggc

SEQ ID NO: 5236 - DNA, 170 bp, Homo sapiens
gctgttgccgaaaggctgtggagcaacaagttgacatctgacctgacatttgcctatgaacgtttgtcacacttccgctgtgaattgctgaggtaagcaagctgtggggccttcgcaaggcggagcaggccagatccagggctggggaaccccttagagagaggaagaca

SEQ ID NO: 5237 - DNA, 170 bp, Homo sapiens
tccaggcccagagcaggggctgttgccgaaaggctgtggagcaacaagttgacatctgacctgacatttgcctatgaacgtttgtcacacttccgctgtgaattgctgaggtaagcaagctgtggggccttcgcaaggcggagcaggccagatccagggctggggaaccc

SEQ ID NO: 5238 - DNA, 170 bp, Homo sapiens
gcccaatctggcacatgccccttttcctccaggcccagagcaggggctgttgccgaaaggctgtggagcaacaagttgacatctgacctgacatttgcctatgaacgtttgtcacacttccgctgtgaattgctgaggtaagcaagctgtggggccttcgcaaggcggag

SEQ ID NO: 5239 - DNA, 170 bp, Homo sapiens
agcacctttgcagggaatacagggcccaatctggcacatgccccttttcctccaggcccagagcaggggctgttgccgaaaggctgtggagcaacaagttgacatctgacctgacatttgcctatgaacgtttgtcacacttccgctgtgaattgctgaggtaagcaagc

SEQ ID NO: 5240 - DNA, 170 bp, Homo sapiens
acaagaggtagcagcctgtggatgtccagcacctttgcagggaatacagggcccaatctggcacatgccccttttcctccaggcccagagcaggggctgttgccgaaaggctgtggagcaacaagttgacatctgacctgacatttgcctatgaacgtttgtcacacttc

SEQ ID NO: 5241 - DNA, 170 bp, Homo sapiens
tgagtgagtccagggtgcctagacaagaggtagcagcctgtggatgtccagcacctttgcagggaatacagggcccaatctggcacatgccccttttcctccaggcccagagcaggggctgttgccgaaaggctgtggagcaacaagttgacatctgacctgacatttgc

SEQ ID NO: 5242 - DNA, 170 bp, Homo sapiens
cataacaaggtattgatcacttcctttggcctgagtgagtccagggtgcctagacaagaggtagcagcctgtggatgtccagcacctttgcagggaatacagggcccaatctggcacatgccccttttcctccaggcccagagcaggggctgttgccgaaaggctgtgga

SEQ ID NO: 5243 - DNA, 170 bp, Homo sapiens
agcaggagtttgaacagacctgagccccaggcaccgaggagggtgctggctgtaggtgaatggtagtggagccaggcttccactgcatcctggccaggggacggagccccttgccttcgtgccccttgcctgcgtgcccctgtgcttggagagaaaggggccggtgctgg

SEQ ID NO: 5244 - DNA, 170 bp, Homo sapiens
ccaacccctcaatgtaggcttctgtgagcaggagtttgaacagacctgagccccaggcaccgaggagggtgctggctgtaggtgaatggtagtggagccaggcttccactgcatcctggccaggggacggagccccttgccttcgtgccccttgcctgcgtgcccctgtg

SEQ ID NO: 5245 - DNA, 170 bp, Homo sapiens
cttgcaggcgaggtgtccaggcccaacccctcaatgtaggcttctgtgagcaggagtttgaacagacctgagccccaggcaccgaggagggtgctggctgtaggtgaatggtagtggagccaggcttccactgcatcctggccaggggacggagccccttgccttcgtgc

SEQ ID NO: 5246 - DNA, 170 bp, Homo sapiens
gcttatcttgccatttcttcatgtcctcttgcaggcgaggtgtccaggcccaacccctcaatgtaggcttctgtgagcaggagtttgaacagacctgagccccaggcaccgaggagggtgctggctgtaggtgaatggtagtggagccaggcttccactgcatcctggcc

SEQ ID NO: 5247 - DNA, 170 bp, Homo sapiens
gctggggccccttctgaggggcttatcttgccatttcttcatgtcctcttgcaggcgaggtgtccaggcccaacccctcaatgtaggcttctgtgagcaggagtttgaacagacctgagccccaggcaccgaggagggtgctggctgtaggtgaatggtagtggagccag

SEQ ID NO: 5248 - DNA, 170 bp, Homo sapiens
agagactgttgactggtgtgaaaagtgttgctggggccccttctgaggggcttatcttgccatttcttcatgtcctcttgcaggcgaggtgtccaggcccaacccctcaatgtaggcttctgtgagcaggagtttgaacagacctgagccccaggcaccgaggagggtgc

SEQ ID NO: 5249 - DNA, 170 bp, Homo sapiens
gagtcaccgaaatggggaaggagagactgttgactggtgtgaaaagtgttgctggggccccttctgaggggcttatcttgccatttcttcatgtcctcttgcaggcgaggtgtccaggcccaacccctcaatgtaggcttctgtgagcaggagtttgaacagacctgagc

SEQ ID NO: 5250 - DNA, 170 bp, Homo sapiens
gtgcatttggtgtacagtgacagtttgagagtcaccgaaatggggaaggagagactgttgactggtgtgaaaagtgttgctggggccccttctgaggggcttatcttgccatttcttcatgtcctcttgcaggcgaggtgtccaggcccaacccctcaatgtaggcttct

SEQ ID NO: 5251 - DNA, 170 bp, Homo sapiens
cctggatgtaaccagcttcctactttggagtcagtggagaattgtaagtaccatcctgttccctgtcttagaagagcaaacacttgtctgaagctgtaactctggatggcctggcctaaactgctgatgctcggcctggagtcccccttgaccctggggaccgagggtca

SEQ ID NO: 5252 - DNA, 170 bp, Homo sapiens
tgtgttggttgtctctgtagtcacacctggatgtaaccagcttcctactttggagtcagtggagaattgtaagtaccatcctgttccctgtcttagaagagcaaacacttgtctgaagctgtaactctggatggcctggcctaaactgctgatgctcggcctggagtccc

SEQ ID NO: 5253 - DNA, 170 bp, Homo sapiens
acggcatacactggagaagaatgtgttggttgtctctgtagtcacacctggatgtaaccagcttcctactttggagtcagtggagaattgtaagtaccatcctgttccctgtcttagaagagcaaacacttgtctgaagctgtaactctggatggcctggcctaaactgc

SEQ ID NO: 5254 - DNA, 170 bp, Homo sapiens
ccaagcttaccctgtcttcctagggaaacggcatacactggagaagaatgtgttggttgtctctgtagtcacacctggatgtaaccagcttcctactttggagtcagtggagaattgtaagtaccatcctgttccctgtcttagaagagcaaacacttgtctgaagctgt

SEQ ID NO: 5255 - DNA, 170 bp, Homo sapiens
ttctaatggcaggttggccgcaccaagcttaccctgtcttcctagggaaacggcatacactggagaagaatgtgttggttgtctctgtagtcacacctggatgtaaccagcttcctactttggagtcagtggagaattgtaagtaccatcctgttccctgtcttagaaga

SEQ ID NO: 5256 - DNA, 170 bp, Homo sapiens
gctagggtcttggttttgcctgttgcttctaatggcaggttggccgcaccaagcttaccctgtcttcctagggaaacggcatacactggagaagaatgtgttggttgtctctgtagtcacacctggatgtaaccagcttcctactttggagtcagtggagaattgtaagt

SEQ ID NO: 5257 - DNA, 170 bp, Homo sapiens
acaggcgtgtgagctgagggactagagctagggtcttggttttgcctgttgcttctaatggcaggttggccgcaccaagcttaccctgtcttcctagggaaacggcatacactggagaagaatgtgttggttgtctctgtagtcacacctggatgtaaccagcttcctac

SEQ ID NO: 5258 - DNA, 170 bp, Homo sapiens
gccatgtcctccctttcctttaccacaggcgtgtgagctgagggactagagctagggtcttggttttgcctgttgcttctaatggcaggttggccgcaccaagcttaccctgtcttcctagggaaacggcatacactggagaagaatgtgttggttgtctctgtagtcac

SEQ ID NO: 5259 - DNA, 170 bp, Homo sapiens
ggcactgcctatgccaagggtaaatgccatgtcctccctttcctttaccacaggcgtgtgagctgagggactagagctagggtcttggttttgcctgttgcttctaatggcaggttggccgcaccaagcttaccctgtcttcctagggaaacggcatacactggagaaga

SEQ ID NO: 5260 - DNA, 170 bp, Homo sapiens
ctctgagactgtctggggagctctccgaggtaacaaattggggctgattaaaagagagagagaaaggatgatgtgggaaggttggtgttggtggagtgcagtggcccagtccctgctcactgcaacctctgcctcctaggctcaagcaatcttccctctttagcctccca

SEQ ID NO: 5261 - DNA, 170 bp, Homo sapiens
ccataaatgatgaccagtgtttactcctctctgagactgtctggggagctctccgaggtaacaaattggggctgattaaaagagagagagaaaggatgatgtgggaaggttggtgttggtggagtgcagtggcccagtccctgctcactgcaacctctgcctcctaggct

SEQ ID NO: 5262 - DNA, 170 bp, Homo sapiens
catttctgtcatttcagataccctgaccataaatgatgaccagtgtttactcctctctgagactgtctggggagctctccgaggtaacaaattggggctgattaaaagagagagagaaaggatgatgtgggaaggttggtgttggtggagtgcagtggcccagtccctgc

SEQ ID NO: 5263 - DNA, 170 bp, Homo sapiens
accttaaccaactaaatgagttcatttctgtcatttcagataccctgaccataaatgatgaccagtgtttactcctctctgagactgtctggggagctctccgaggtaacaaattggggctgattaaaagagagagagaaaggatgatgtgggaaggttggtgttggtgg

SEQ ID NO: 5264 - DNA, 170 bp, Homo sapiens
tctggtctataatctgagaatagaaaaccttaaccaactaaatgagttcatttctgtcatttcagataccctgaccataaatgatgaccagtgtttactcctctctgagactgtctggggagctctccgaggtaacaaattggggctgattaaaagagagagagaaagga

SEQ ID NO: 5265 - DNA, 170 bp, Homo sapiens
agtccagtgatttatatagaatatctggtctataatctgagaatagaaaaccttaaccaactaaatgagttcatttctgtcatttcagataccctgaccataaatgatgaccagtgtttactcctctctgagactgtctggggagctctccgaggtaacaaattggggct

SEQ ID NO: 5266 - DNA, 170 bp, Homo sapiens
atatggtcttactgttttttttttttagtccagtgatttatatagaatatctggtctataatctgagaatagaaaaccttaaccaactaaatgagttcatttctgtcatttcagataccctgaccataaatgatgaccagtgtttactcctctctgagactgtctgggga

SEQ ID NO: 5267 - DNA, 170 bp, Homo sapiens
ctcctcattgaaagattttttaaaatatatggtcttactgttttttttttttagtccagtgatttatatagaatatctggtctataatctgagaatagaaaaccttaaccaactaaatgagttcatttctgtcatttcagataccctgaccataaatgatgaccagtgtt

SEQ ID NO: 5268 - DNA, 170 bp, Homo sapiens
ggaaatctgctgagggcacagtaagtgtggaccctcaaaaagggctcctttttcatctctggggttggatcccaatattgagaatcctagaaaaatcttgttttgccttaggatcctggtggcttgagatagccccagtagaaatggaagaggagatgtgagtggaaaac

SEQ ID NO: 5269 - DNA, 170 bp, Homo sapiens
tctggagacttttagccagcttgtttggaaatctgctgagggcacagtaagtgtggaccctcaaaaagggctcctttttcatctctggggttggatcccaatattgagaatcctagaaaaatcttgttttgccttaggatcctggtggcttgagatagccccagtagaaa

SEQ ID NO: 5270 - DNA, 170 bp, Homo sapiens
tctgcctctctacatcttcctaggtctggagacttttagccagcttgtttggaaatctgctgagggcacagtaagtgtggaccctcaaaaagggctcctttttcatctctggggttggatcccaatattgagaatcctagaaaaatcttgttttgccttaggatcctggt

SEQ ID NO: 5271 - DNA, 170 bp, Homo sapiens
tttccactccctgagtctttactctgcctctctacatcttcctaggtctggagacttttagccagcttgtttggaaatctgctgagggcacagtaagtgtggaccctcaaaaagggctcctttttcatctctggggttggatcccaatattgagaatcctagaaaaatct

SEQ ID NO: 5272 - DNA, 170 bp, Homo sapiens
tgagaaccttccaaatagagacatctctttttccactccctgagtctttactctgcctctctacatcttcctaggtctggagacttttagccagcttgtttggaaatctgctgagggcacagtaagtgtggaccctcaaaaagggctcctttttcatctctggggttgga

SEQ ID NO: 5273 - DNA, 170 bp, Homo sapiens
cccaaatgttatgctctgctacattgagaaccttccaaatagagacatctctttttccactccctgagtctttactctgcctctctacatcttcctaggtctggagacttttagccagcttgtttggaaatctgctgagggcacagtaagtgtggaccctcaaaaagggc

SEQ ID NO: 5274 - DNA, 170 bp, Homo sapiens
cctacactacatccattttccctgtgtacccaaatgttatgctctgctacattgagaaccttccaaatagagacatctctttttccactccctgagtctttactctgcctctctacatcttcctaggtctggagacttttagccagcttgtttggaaatctgctgagggc

SEQ ID NO: 5275 - DNA, 170 bp, Homo sapiens
acctgccactctctagcatcctggacactctggtaaccaggccttaaggccttcttcacacttaagagttctagggtgatggagcaacggacagaccaagttccaaattcttaaagagttagagagggaatgtatggactgggtgtggtggctcatgcctgtaatcccaa

SEQ ID NO: 5276 - DNA, 170 bp, Homo sapiens
gcttgctgttggatacatctcgccattacctgccactctctagcatcctggacactctggtaaccaggccttaaggccttcttcacacttaagagttctagggtgatggagcaacggacagaccaagttccaaattcttaaagagttagagagggaatgtatggactggg

SEQ ID NO: 5277 - DNA, 170 bp, Homo sapiens
tccccgctttcctcaccggggcttgctgttggatacatctcgccattacctgccactctctagcatcctggacactctggtaaccaggccttaaggccttcttcacacttaagagttctagggtgatggagcaacggacagaccaagttccaaattcttaaagagttaga

SEQ ID NO: 5278 - DNA, 170 bp, Homo sapiens
cagttctttatcaacaagactgagattgaggactttccccgctttcctcaccggggcttgctgttggatacatctcgccattacctgccactctctagcatcctggacactctggtaaccaggccttaaggccttcttcacacttaagagttctagggtgatggagcaac

SEQ ID NO: 5279 - DNA, 170 bp, Homo sapiens
gttcaatgtttgttctgcacagttctttatcaacaagactgagattgaggactttccccgctttcctcaccggggcttgctgttggatacatctcgccattacctgccactctctagcatcctggacactctggtaaccaggccttaaggccttcttcacacttaagagt

SEQ ID NO: 5280 - DNA, 170 bp, Homo sapiens
agtaagcttcctttgaaactgacatgttcaatgtttgttctgcacagttctttatcaacaagactgagattgaggactttccccgctttcctcaccggggcttgctgttggatacatctcgccattacctgccactctctagcatcctggacactctggtaaccaggcct

SEQ ID NO: 5281 - DNA, 170 bp, Homo sapiens
ttgtcttcatctccctgtgcccccatagtaagcttcctttgaaactgacatgttcaatgtttgttctgcacagttctttatcaacaagactgagattgaggactttccccgctttcctcaccggggcttgctgttggatacatctcgccattacctgccactctctagca

SEQ ID NO: 5282 - DNA, 170 bp, Homo sapiens
tggctttttaagaatcctgggagagttgtcttcatctccctgtgcccccatagtaagcttcctttgaaactgacatgttcaatgtttgttctgcacagttctttatcaacaagactgagattgaggactttccccgctttcctcaccggggcttgctgttggatacatct

SEQ ID NO: 5283 - DNA, 170 bp, Homo sapiens
gcgaccctgagaacagtcacagattggctttttaagaatcctgggagagttgtcttcatctccctgtgcccccatagtaagcttcctttgaaactgacatgttcaatgtttgttctgcacagttctttatcaacaagactgagattgaggactttccccgctttcctcac

SEQ ID NO: 5284 - DNA, 170 bp, Homo sapiens
ggtggggagcatttagggagagagcgaccctgagaacagtcacagattggctttttaagaatcctgggagagttgtcttcatctccctgtgcccccatagtaagcttcctttgaaactgacatgttcaatgtttgttctgcacagttctttatcaacaagactgagattg

SEQ ID NO: 5285 - DNA, 170 bp, Homo sapiens
ttccagagctcatgagaaaggtatgttcccgtttcactcagaccaagtttatgggtcaatgtctgaatctggctgtggccctgctggcaagaacagggtctctcatcctaaccagccagttttagaccaatataggggaaggacactggatttggagtcaggagacttga

SEQ ID NO: 5286 - DNA, 170 bp, Homo sapiens
tccttcccatatgagagcttcacttttccagagctcatgagaaaggtatgttcccgtttcactcagaccaagtttatgggtcaatgtctgaatctggctgtggccctgctggcaagaacagggtctctcatcctaaccagccagttttagaccaatataggggaaggaca

SEQ ID NO: 5287 - DNA, 170 bp, Homo sapiens
ccactggcatctggtagatgatccttccttcccatatgagagcttcacttttccagagctcatgagaaaggtatgttcccgtttcactcagaccaagtttatgggtcaatgtctgaatctggctgtggccctgctggcaagaacagggtctctcatcctaaccagccagt

SEQ ID NO: 5288 - DNA, 170 bp, Homo sapiens
tgtcatggcgtacaataaattgaacgtgttccactggcatctggtagatgatccttccttcccatatgagagcttcacttttccagagctcatgagaaaggtatgttcccgtttcactcagaccaagtttatgggtcaatgtctgaatctggctgtggccctgctggcaa

SEQ ID NO: 5289 - DNA, 170 bp, Homo sapiens
gtgcactttaacctacaggatgtcatggcgtacaataaattgaacgtgttccactggcatctggtagatgatccttccttcccatatgagagcttcacttttccagagctcatgagaaaggtatgttcccgtttcactcagaccaagtttatgggtcaatgtctgaatct

SEQ ID NO: 5290 - DNA, 170 bp, Homo sapiens
cggagagactgtgatgggttcacagtgtgcactttaacctacaggatgtcatggcgtacaataaattgaacgtgttccactggcatctggtagatgatccttccttcccatatgagagcttcacttttccagagctcatgagaaaggtatgttcccgtttcactcagacc

SEQ ID NO: 5291 - DNA, 170 bp, Homo sapiens
catcgcaagtttgaggctgaaaccggagagactgtgatgggttcacagtgtgcactttaacctacaggatgtcatggcgtacaataaattgaacgtgttccactggcatctggtagatgatccttccttcccatatgagagcttcacttttccagagctcatgagaaagg

SEQ ID NO: 5292 - DNA, 170 bp, Homo sapiens
agcggcctgagagctcgcccaacatcgcaagtttgaggctgaaaccggagagactgtgatgggttcacagtgtgcactttaacctacaggatgtcatggcgtacaataaattgaacgtgttccactggcatctggtagatgatccttccttcccatatgagagcttcact

SEQ ID NO: 5293 - DNA, 170 bp, Homo sapiens
ggcaggtcaagcctgtaggggtgtgtggagcggcctgagagctcgcccaacatcgcaagtttgaggctgaaaccggagagactgtgatgggttcacagtgtgcactttaacctacaggatgtcatggcgtacaataaattgaacgtgttccactggcatctggtagatga

SEQ ID NO: 5294 - DNA, 170 bp, Homo sapiens
accccataaatacttaattgagagctgaggcaggtcaagcctgtaggggtgtgtggagcggcctgagagctcgcccaacatcgcaagtttgaggctgaaaccggagagactgtgatgggttcacagtgtgcactttaacctacaggatgtcatggcgtacaataaattga

SEQ ID NO: 5295 - DNA, 170 bp, Homo sapiens
cactttgtcctggggaccaggtaagaatgatgtctgggaccagagggactctgcttgttatgctcagagtgaagcttcagggcactggctcatggaagtggcatatcccagccttggtccttagaagaatgttttccatcgacttcttccacctgggaatttagatagga

SEQ ID NO: 5296 - DNA, 170 bp, Homo sapiens
tgcagagtttgacactcctggccacactttgtcctggggaccaggtaagaatgatgtctgggaccagagggactctgcttgttatgctcagagtgaagcttcagggcactggctcatggaagtggcatatcccagccttggtccttagaagaatgttttccatcgacttc

SEQ ID NO: 5297 - DNA, 170 bp, Homo sapiens
tttgaagatagtccctgacaccaaagggctatgggcaggttttctgatatctggggagtcttgtgggcattttgagtatcttctactctgctagctttcaggaagtgtgaacctgaagggtgtcttgtgcctttcaggggtcctacaaccctgtcacccacatctacaca

SEQ ID NO: 5298 - DNA, 170 bp, Homo sapiens
cacggctccggggtatccgtgtgcttgcagagtttgacactcctggccacactttgtcctggggaccaggtaagaatgatgtctgggaccagagggactctgcttgttatgctcagagtgaagcttcagggcactggctcatggaagtggcatatcccagccttggtcct

SEQ ID NO: 5299 - DNA, 170 bp, Homo sapiens
acaggatgtgaaggaggtcattgaatacgcacggctccggggtatccgtgtgcttgcagagtttgacactcctggccacactttgtcctggggaccaggtaagaatgatgtctgggaccagagggactctgcttgttatgctcagagtgaagcttcagggcactggctca

SEQ ID NO: 5300 - DNA, 170 bp, Homo sapiens
ctgtcacccacatctacacagcacaggatgtgaaggaggtcattgaatacgcacggctccggggtatccgtgtgcttgcagagtttgacactcctggccacactttgtcctggggaccaggtaagaatgatgtctgggaccagagggactctgcttgttatgctcagagt

SEQ ID NO: 5301 - DNA, 170 bp, Homo sapiens
tgcctttcaggggtcctacaaccctgtcacccacatctacacagcacaggatgtgaaggaggtcattgaatacgcacggctccggggtatccgtgtgcttgcagagtttgacactcctggccacactttgtcctggggaccaggtaagaatgatgtctgggaccagaggg

SEQ ID NO: 5302 - DNA, 170 bp, Homo sapiens
aggaagtgtgaacctgaagggtgtcttgtgcctttcaggggtcctacaaccctgtcacccacatctacacagcacaggatgtgaaggaggtcattgaatacgcacggctccggggtatccgtgtgcttgcagagtttgacactcctggccacactttgtcctggggacca

SEQ ID NO: 5303 - DNA, 170 bp, Homo sapiens
agtatcttctactctgctagctttcaggaagtgtgaacctgaagggtgtcttgtgcctttcaggggtcctacaaccctgtcacccacatctacacagcacaggatgtgaaggaggtcattgaatacgcacggctccggggtatccgtgtgcttgcagagtttgacactcc

SEQ ID NO: 5304 - DNA, 170 bp, Homo sapiens
tatctggggagtcttgtgggcattttgagtatcttctactctgctagctttcaggaagtgtgaacctgaagggtgtcttgtgcctttcaggggtcctacaaccctgtcacccacatctacacagcacaggatgtgaaggaggtcattgaatacgcacggctccggggtat

SEQ ID NO: 5305 - DNA, 170 bp, Homo sapiens
gggctatgggcaggttttctgatatctggggagtcttgtgggcattttgagtatcttctactctgctagctttcaggaagtgtgaacctgaagggtgtcttgtgcctttcaggggtcctacaaccctgtcacccacatctacacagcacaggatgtgaaggaggtcattg

SEQ ID NO: 5306 - DNA, 170 bp, Homo sapiens
tggaggagatgaggttgatttcacctgctggtatgagccctttgatcttcccactgtggcctgatcagttgcttactcagaatagaagttagcacccgaggggctgcttagctcagctgctgctctcaggggtctgtatgggctcacattgctcaggtcttaggccttcc

SEQ ID NO: 5307 - DNA, 170 bp, Homo sapiens
tgtcttcccagatttttatcttcatcttggaggagatgaggttgatttcacctgctggtatgagccctttgatcttcccactgtggcctgatcagttgcttactcagaatagaagttagcacccgaggggctgcttagctcagctgctgctctcaggggtctgtatgggc

SEQ ID NO: 5308 - DNA, 170 bp, Homo sapiens
cacttgtcttgctttgtgtgactcgtgtccttacgtgtaggactgtgcgtgggggtttatgtatttgtgacactcatatggggttttctcttggcttaggtatccctggattactgactccttgctactctgggtctgagccctctggcacctttggaccagtgaatccc

SEQ ID NO: 5309 - DNA, 170 bp, Homo sapiens
cctaaatgtgtgtgatgtttatgaatacacttgtcttgctttgtgtgactcgtgtccttacgtgtaggactgtgcgtgggggtttatgtatttgtgacactcatatggggttttctcttggcttaggtatccctggattactgactccttgctactctgggtctgagccc

SEQ ID NO: 5310 - DNA, 170 bp, Homo sapiens
gcacattcttcttagaagtcagctctgtcttcccagatttttatcttcatcttggaggagatgaggttgatttcacctgctggtatgagccctttgatcttcccactgtggcctgatcagttgcttactcagaatagaagttagcacccgaggggctgcttagctcagct

SEQ ID NO: 5311 - DNA, 170 bp, Homo sapiens
ataatacctatgagttcatgagcacattcttcttagaagtcagctctgtcttcccagatttttatcttcatcttggaggagatgaggttgatttcacctgctggtatgagccctttgatcttcccactgtggcctgatcagttgcttactcagaatagaagttagcaccc

SEQ ID NO: 5312 - DNA, 170 bp, Homo sapiens
acctttggaccagtgaatcccagtctcaataatacctatgagttcatgagcacattcttcttagaagtcagctctgtcttcccagatttttatcttcatcttggaggagatgaggttgatttcacctgctggtatgagccctttgatcttcccactgtggcctgatcagt

SEQ ID NO: 5313 - DNA, 170 bp, Homo sapiens
tctgggtctgagccctctggcacctttggaccagtgaatcccagtctcaataatacctatgagttcatgagcacattcttcttagaagtcagctctgtcttcccagatttttatcttcatcttggaggagatgaggttgatttcacctgctggtatgagccctttgatct

SEQ ID NO: 5314 - DNA, 170 bp, Homo sapiens
ttaggtatccctggattactgactccttgctactctgggtctgagccctctggcacctttggaccagtgaatcccagtctcaataatacctatgagttcatgagcacattcttcttagaagtcagctctgtcttcccagatttttatcttcatcttggaggagatgaggt

SEQ ID NO: 5315 - DNA, 170 bp, Homo sapiens
tggggttttctcttggcttaggtatccctggattactgactccttgctactctgggtctgagccctctggcacctttggaccagtgaatcccagtctcaataatacctatgagttcatgagcacattcttcttagaagtcagctctgtcttcccagatttttatcttcat

SEQ ID NO: 5316 - DNA, 170 bp, Homo sapiens
gggtttatgtatttgtgacactcatatggggttttctcttggcttaggtatccctggattactgactccttgctactctgggtctgagccctctggcacctttggaccagtgaatcccagtctcaataatacctatgagttcatgagcacattcttcttagaagtcagct

SEQ ID NO: 5317 - DNA, 170 bp, Homo sapiens
ccttacgtgtaggactgtgcgtgggggtttatgtatttgtgacactcatatggggttttctcttggcttaggtatccctggattactgactccttgctactctgggtctgagccctctggcacctttggaccagtgaatcccagtctcaataatacctatgagttcatga

SEQ ID NO: 5318 - DNA, 170 bp, Homo sapiens
ggagtccttctacatccagacgtgaggaaggaaggagggtgggtggggtcccttgggggtcctcctgtggggtcctccctttccataccgagtcaggccctgcttggccactgtctggtccctgcagggttcccttgtcctttgtcccatcctttcagatttggagtggt

SEQ ID NO: 5319 - DNA, 170 bp, Homo sapiens
gcttcggtgaggacttcaagcagctggagtccttctacatccagacgtgaggaaggaaggagggtgggtggggtcccttgggggtcctcctgtggggtcctccctttccataccgagtcaggccctgcttggccactgtctggtccctgcagggttcccttgtcctttgt

SEQ ID NO: 5320 - DNA, 170 bp, Homo sapiens
agatccaggactttatgaggaagaaaggcttcggtgaggacttcaagcagctggagtccttctacatccagacgtgaggaaggaaggagggtgggtggggtcccttgggggtcctcctgtggggtcctccctttccataccgagtcaggccctgcttggccactgtctgg

SEQ ID NO: 5321 - DNA, 170 bp, Homo sapiens
gggattcaggaagtccaacccagagatccaggactttatgaggaagaaaggcttcggtgaggacttcaagcagctggagtccttctacatccagacgtgaggaaggaaggagggtgggtggggtcccttgggggtcctcctgtggggtcctccctttccataccgagtca

SEQ ID NO: 5322 - DNA, 170 bp, Homo sapiens
tgttgaaagattaatcttcattttctcttgggattcaggaagtccaacccagagatccaggactttatgaggaagaaaggcttcggtgaggacttcaagcagctggagtccttctacatccagacgtgaggaaggaaggagggtgggtggggtcccttgggggtcctcct

SEQ ID NO: 5323 - DNA, 170 bp, Homo sapiens
cccaggcattaggctttcaggatgttgaaagattaatcttcattttctcttgggattcaggaagtccaacccagagatccaggactttatgaggaagaaaggcttcggtgaggacttcaagcagctggagtccttctacatccagacgtgaggaaggaaggagggtgggt

SEQ ID NO: 5324 - DNA, 170 bp, Homo sapiens
agggggccaggtgactaatccccaggcattaggctttcaggatgttgaaagattaatcttcattttctcttgggattcaggaagtccaacccagagatccaggactttatgaggaagaaaggcttcggtgaggacttcaagcagctggagtccttctacatccagacgtg

SEQ ID NO: 5325 - DNA, 170 bp, Homo sapiens
tttgatttttcaggtgaaaagaggaagttatagggggccaggtgactaatccccaggcattaggctttcaggatgttgaaagattaatcttcattttctcttgggattcaggaagtccaacccagagatccaggactttatgaggaagaaaggcttcggtgaggacttca

SEQ ID NO: 5326 - DNA, 170 bp, Homo sapiens
ggcttctgagatccttgcttatttgatttttcaggtgaaaagaggaagttatagggggccaggtgactaatccccaggcattaggctttcaggatgttgaaagattaatcttcattttctcttgggattcaggaagtccaacccagagatccaggactttatgaggaaga

SEQ ID NO: 5327 - DNA, 170 bp, Homo sapiens
tagaagtagaccctgtctcaagagaagtaagttactgatgtagaatgccagcatgtgggtatgacccttgatttctcttcttccaaatttctttccccacatggtctttctttatatcttattgaatttatatcctcccaaataaacatcttttgcttcatatatatgcc

SEQ ID NO: 5328 - DNA, 170 bp, Homo sapiens
ggttcagaacatggcctgatagaagtagaccctgtctcaagagaagtaagttactgatgtagaatgccagcatgtgggtatgacccttgatttctcttcttccaaatttctttccccacatggtctttctttatatcttattgaatttatatcctcccaaataaacatct

SEQ ID NO: 5329 - DNA, 170 bp, Homo sapiens
cccctgaatcatttcatttaaataaatatggtcatttatcactattaagctatttatttttctcttagagattaatgattcatcaagggatagttgtacttgtctcgtgggaatcacttcatcatgcgaaatctgaaattatttcggaccctggagttcagggatattca

SEQ ID NO: 5330 - DNA, 170 bp, Homo sapiens
tctgactaccacttcttcaccccctgaatcatttcatttaaataaatatggtcatttatcactattaagctatttatttttctcttagagattaatgattcatcaagggatagttgtacttgtctcgtgggaatcacttcatcatgcgaaatctgaaattatttcggacc

SEQ ID NO: 5331 - DNA, 170 bp, Homo sapiens
tgaacaggggacggtgctcattggttcagaacatggcctgatagaagtagaccctgtctcaagagaagtaagttactgatgtagaatgccagcatgtgggtatgacccttgatttctcttcttccaaatttctttccccacatggtctttctttatatcttattgaattt

SEQ ID NO: 5332 - DNA, 170 bp, Homo sapiens
ggaatcctcagtgcttctctctccgaactgaacaggggacggtgctcattggttcagaacatggcctgatagaagtagaccctgtctcaagagaagtaagttactgatgtagaatgccagcatgtgggtatgacccttgatttctcttcttccaaatttctttccccaca

SEQ ID NO: 5333 - DNA, 170 bp, Homo sapiens
tggagttcagggatattcaaggtccagggaatcctcagtgcttctctctccgaactgaacaggggacggtgctcattggttcagaacatggcctgatagaagtagaccctgtctcaagagaagtaagttactgatgtagaatgccagcatgtgggtatgacccttgattt

SEQ ID NO: 5334 - DNA, 170 bp, Homo sapiens
cgaaatctgaaattatttcggaccctggagttcagggatattcaaggtccagggaatcctcagtgcttctctctccgaactgaacaggggacggtgctcattggttcagaacatggcctgatagaagtagaccctgtctcaagagaagtaagttactgatgtagaatgcc

SEQ ID NO: 5335 - DNA, 170 bp, Homo sapiens
tctcgtgggaatcacttcatcatgcgaaatctgaaattatttcggaccctggagttcagggatattcaaggtccagggaatcctcagtgcttctctctccgaactgaacaggggacggtgctcattggttcagaacatggcctgatagaagtagaccctgtctcaagaga

SEQ ID NO: 5336 - DNA, 170 bp, Homo sapiens
tgattcatcaagggatagttgtacttgtctcgtgggaatcacttcatcatgcgaaatctgaaattatttcggaccctggagttcagggatattcaaggtccagggaatcctcagtgcttctctctccgaactgaacaggggacggtgctcattggttcagaacatggcct

SEQ ID NO: 5337 - DNA, 170 bp, Homo sapiens
atttatttttctcttagagattaatgattcatcaagggatagttgtacttgtctcgtgggaatcacttcatcatgcgaaatctgaaattatttcggaccctggagttcagggatattcaaggtccagggaatcctcagtgcttctctctccgaactgaacaggggacggt

SEQ ID NO: 5338 - DNA, 170 bp, Homo sapiens
atggtcatttatcactattaagctatttatttttctcttagagattaatgattcatcaagggatagttgtacttgtctcgtgggaatcacttcatcatgcgaaatctgaaattatttcggaccctggagttcagggatattcaaggtccagggaatcctcagtgcttctc

SEQ ID NO: 5339 - DNA, 170 bp, Homo sapiens
ggagataattcaagtgacttgtccaatgtggctgtcattgatggaagtaagctcctgggaagtgtgtccatgagcctgcaaggggtcctgagcctagggcctgcagatgtggtggtttgactggaacagtggggaatctttatttgttttggctgtttgggttacttgtt

SEQ ID NO: 5340 - DNA, 170 bp, Homo sapiens
acgactgaccggagcgtgggagataattcaagtgacttgtccaatgtggctgtcattgatggaagtaagctcctgggaagtgtgtccatgagcctgcaaggggtcctgagcctagggcctgcagatgtggtggtttgactggaacagtggggaatctttatttgttttgg

SEQ ID NO: 5341 - DNA, 170 bp, Homo sapiens
tggcaagtgggatgaagtctgcttcccagcctctaacggccttcttttcattttcccttgcagttcagctctggactgttggaaactatcactggtatctcaagcaaagtttatccttcagcacctgtgggaagagcaagattgtgtctctgatgtgggaccctgtgacc

SEQ ID NO: 5342 - DNA, 170 bp, Homo sapiens
agaaaagattgcccttgaacccctctggcaagtgggatgaagtctgcttcccagcctctaacggccttcttttcattttcccttgcagttcagctctggactgttggaaactatcactggtatctcaagcaaagtttatccttcagcacctgtgggaagagcaagattgt

SEQ ID NO: 5343 - DNA, 170 bp, Homo sapiens
tgagcaggaagggtcctttgaaaaagaaaagattgcccttgaacccctctggcaagtgggatgaagtctgcttcccagcctctaacggccttcttttcattttcccttgcagttcagctctggactgttggaaactatcactggtatctcaagcaaagtttatccttcag

SEQ ID NO: 5344 - DNA, 170 bp, Homo sapiens
attgttcttattttagagacgaggctgagcaggaagggtcctttgaaaaagaaaagattgcccttgaacccctctggcaagtgggatgaagtctgcttcccagcctctaacggccttcttttcattttcccttgcagttcagctctggactgttggaaactatcactggt

SEQ ID NO: 5345 - DNA, 170 bp, Homo sapiens
tggcattacctcgcctatgattggcactggacgactgaccggagcgtgggagataattcaagtgacttgtccaatgtggctgtcattgatggaagtaagctcctgggaagtgtgtccatgagcctgcaaggggtcctgagcctagggcctgcagatgtggtggtttgact

SEQ ID NO: 5346 - DNA, 170 bp, Homo sapiens
tgcatgttctctgtcagggctggcattacctcgcctatgattggcactggacgactgaccggagcgtgggagataattcaagtgacttgtccaatgtggctgtcattgatggaagtaagctcctgggaagtgtgtccatgagcctgcaaggggtcctgagcctagggcct

SEQ ID NO: 5347 - DNA, 170 bp, Homo sapiens
tgtgggaccctgtgaccccataccggctgcatgttctctgtcagggctggcattacctcgcctatgattggcactggacgactgaccggagcgtgggagataattcaagtgacttgtccaatgtggctgtcattgatggaagtaagctcctgggaagtgtgtccatgagc

SEQ ID NO: 5348 - DNA, 170 bp, Homo sapiens
gtgggaagagcaagattgtgtctctgatgtgggaccctgtgaccccataccggctgcatgttctctgtcagggctggcattacctcgcctatgattggcactggacgactgaccggagcgtgggagataattcaagtgacttgtccaatgtggctgtcattgatggaagt

SEQ ID NO: 5349 - DNA, 170 bp, Homo sapiens
agcaaagtttatccttcagcacctgtgggaagagcaagattgtgtctctgatgtgggaccctgtgaccccataccggctgcatgttctctgtcagggctggcattacctcgcctatgattggcactggacgactgaccggagcgtgggagataattcaagtgacttgtcc

SEQ ID NO: 5350 - DNA, 170 bp, Homo sapiens
ggactgttggaaactatcactggtatctcaagcaaagtttatccttcagcacctgtgggaagagcaagattgtgtctctgatgtgggaccctgtgaccccataccggctgcatgttctctgtcagggctggcattacctcgcctatgattggcactggacgactgaccgg

SEQ ID NO: 5351 - DNA, 170 bp, Homo sapiens
ttttcccttgcagttcagctctggactgttggaaactatcactggtatctcaagcaaagtttatccttcagcacctgtgggaagagcaagattgtgtctctgatgtgggaccctgtgaccccataccggctgcatgttctctgtcagggctggcattacctcgcctatga

SEQ ID NO: 5352 - DNA, 170 bp, Homo sapiens
cagcctctaacggccttcttttcattttcccttgcagttcagctctggactgttggaaactatcactggtatctcaagcaaagtttatccttcagcacctgtgggaagagcaagattgtgtctctgatgtgggaccctgtgaccccataccggctgcatgttctctgtca

SEQ ID NO: 5353 - DNA, 170 bp, Homo sapiens
tgttctagatgccagtaaccagatttctgtttataaatgtggtatgttataaaacttttgccaagatgttctgaatcaagtcccttctactcctacataaaagcaaattatagtttggtgttgccataggtctagtgtttctcaaaatttttaagtctgcagttgatatc

SEQ ID NO: 5354 - DNA, 170 bp, Homo sapiens
cctcaaaagagtaatgaccttgctgttctagatgccagtaaccagatttctgtttataaatgtggtatgttataaaacttttgccaagatgttctgaatcaagtcccttctactcctacataaaagcaaattatagtttggtgttgccataggtctagtgtttctcaaaa

SEQ ID NO: 5355 - DNA, 170 bp, Homo sapiens
ttgaaagttatttttttgtgaattgccattattgtttagatatactgtgatgttcagatggcttatcttacaaattgaatatccctaggtctaatcctcttctttctttttcactgcagacagggtgttggtgacagtcttccggcagactgtggttccgcctcccatgt

SEQ ID NO: 5356 - DNA, 170 bp, Homo sapiens
agacttgttcctgagaaaaacattgaaagttatttttttgtgaattgccattattgtttagatatactgtgatgttcagatggcttatcttacaaattgaatatccctaggtctaatcctcttctttctttttcactgcagacagggtgttggtgacagtcttccggcag

SEQ ID NO: 5357 - DNA, 170 bp, Homo sapiens
tcaagtcacattcttagcacaccctcaaaagagtaatgaccttgctgttctagatgccagtaaccagatttctgtttataaatgtggtatgttataaaacttttgccaagatgttctgaatcaagtcccttctactcctacataaaagcaaattatagtttggtgttgcc

SEQ ID NO: 5358 - DNA, 170 bp, Homo sapiens
gctgttcccacaccctgtgaatcaagtcacattcttagcacaccctcaaaagagtaatgaccttgctgttctagatgccagtaaccagatttctgtttataaatgtggtatgttataaaacttttgccaagatgttctgaatcaagtcccttctactcctacataaaagc

SEQ ID NO: 5359 - DNA, 170 bp, Homo sapiens
ccgcctcccatgtgcacctaccaactgctgttcccacaccctgtgaatcaagtcacattcttagcacaccctcaaaagagtaatgaccttgctgttctagatgccagtaaccagatttctgtttataaatgtggtatgttataaaacttttgccaagatgttctgaatca

SEQ ID NO: 5360 - DNA, 170 bp, Homo sapiens
acagtcttccggcagactgtggttccgcctcccatgtgcacctaccaactgctgttcccacaccctgtgaatcaagtcacattcttagcacaccctcaaaagagtaatgaccttgctgttctagatgccagtaaccagatttctgtttataaatgtggtatgttataaaa

SEQ ID NO: 5361 - DNA, 170 bp, Homo sapiens
tctttttcactgcagacagggtgttggtgacagtcttccggcagactgtggttccgcctcccatgtgcacctaccaactgctgttcccacaccctgtgaatcaagtcacattcttagcacaccctcaaaagagtaatgaccttgctgttctagatgccagtaaccagatt

SEQ ID NO: 5362 - DNA, 170 bp, Homo sapiens
tccctaggtctaatcctcttctttctttttcactgcagacagggtgttggtgacagtcttccggcagactgtggttccgcctcccatgtgcacctaccaactgctgttcccacaccctgtgaatcaagtcacattcttagcacaccctcaaaagagtaatgaccttgctg

SEQ ID NO: 5363 - DNA, 170 bp, Homo sapiens
tcagatggcttatcttacaaattgaatatccctaggtctaatcctcttctttctttttcactgcagacagggtgttggtgacagtcttccggcagactgtggttccgcctcccatgtgcacctaccaactgctgttcccacaccctgtgaatcaagtcacattcttagca

SEQ ID NO: 5364 - DNA, 170 bp, Homo sapiens
gccattattgtttagatatactgtgatgttcagatggcttatcttacaaattgaatatccctaggtctaatcctcttctttctttttcactgcagacagggtgttggtgacagtcttccggcagactgtggttccgcctcccatgtgcacctaccaactgctgttcccac

SEQ ID NO: 5365 - DNA, 170 bp, Homo sapiens
ctcctcatttggaaaagagatacaagtaggttcttaattatcttgggcttctgggaacagaatcagccagcatgcagtcctaaattcagccatctgataacagttctatgcctgttgctgagtggaacaagaaataaagacaacacccaggccctgactttcggatctga

SEQ ID NO: 5366 - DNA, 170 bp, Homo sapiens
ggatttaaagtttgccttagaactcctcatttggaaaagagatacaagtaggttcttaattatcttgggcttctgggaacagaatcagccagcatgcagtcctaaattcagccatctgataacagttctatgcctgttgctgagtggaacaagaaataaagacaacaccc

SEQ ID NO: 5367 - DNA, 170 bp, Homo sapiens
aactgggagctgtgggtggaagtggatttaaagtttgccttagaactcctcatttggaaaagagatacaagtaggttcttaattatcttgggcttctgggaacagaatcagccagcatgcagtcctaaattcagccatctgataacagttctatgcctgttgctgagtgg

SEQ ID NO: 5368 - DNA, 170 bp, Homo sapiens
tgattgtccaagtgctgaccctacagtgaaactgggagctgtgggtggaagtggatttaaagtttgccttagaactcctcatttggaaaagagatacaagtaggttcttaattatcttgggcttctgggaacagaatcagccagcatgcagtcctaaattcagccatctg

SEQ ID NO: 5369 - DNA, 170 bp, Homo sapiens
tatttgcatttttgttttccaggtgattgtccaagtgctgaccctacagtgaaactgggagctgtgggtggaagtggatttaaagtttgccttagaactcctcatttggaaaagagatacaagtaggttcttaattatcttgggcttctgggaacagaatcagccagcat

SEQ ID NO: 5370 - DNA, 170 bp, Homo sapiens
tgaaatcttataatttacgatgataatatttgcatttttgttttccaggtgattgtccaagtgctgaccctacagtgaaactgggagctgtgggtggaagtggatttaaagtttgccttagaactcctcatttggaaaagagatacaagtaggttcttaattatcttggg

SEQ ID NO: 5371 - DNA, 170 bp, Homo sapiens
gcagacaccatccccttagtattaggtgaaatcttataatttacgatgataatatttgcatttttgttttccaggtgattgtccaagtgctgaccctacagtgaaactgggagctgtgggtggaagtggatttaaagtttgccttagaactcctcatttggaaaagagat

SEQ ID NO: 5372 - DNA, 170 bp, Homo sapiens
tgtttgccttctagaactcattaattgcagacaccatccccttagtattaggtgaaatcttataatttacgatgataatatttgcatttttgttttccaggtgattgtccaagtgctgaccctacagtgaaactgggagctgtgggtggaagtggatttaaagtttgcct

SEQ ID NO: 5373 - DNA, 170 bp, Homo sapiens
tgagatgtgattattttctagattgctgtttgccttctagaactcattaattgcagacaccatccccttagtattaggtgaaatcttataatttacgatgataatatttgcatttttgttttccaggtgattgtccaagtgctgaccctacagtgaaactgggagctgtg

SEQ ID NO: 5374 - DNA, 170 bp, Homo sapiens
gaagagcatggacagctcaatgtcaggtattgcagtttttccctgtactccacatgttaagcaaatggagttaggtttttgtcttttatgagcatacaacttttgacttctattgatcaaggttgaggagcagtagctttcttgttagacacacttaacaagaaggttaa

SEQ ID NO: 5375 - DNA, 170 bp, Homo sapiens
actgcagcttcttctgagatggatgaagagcatggacagctcaatgtcaggtattgcagtttttccctgtactccacatgttaagcaaatggagttaggtttttgtcttttatgagcatacaacttttgacttctattgatcaaggttgaggagcagtagctttcttgtt

SEQ ID NO: 5376 - DNA, 170 bp, Homo sapiens
caagatgcttcagtcttccttcatccaggaacgtctcagtggtttttaagttttattcatgtcttggatattcttcaatatttacaatagaatccagtttgagaataatgaagatcaagatgtaaacccgctgaaactaggccttctcacttggattgaagaagacgtct

SEQ ID NO: 5377 - DNA, 170 bp, Homo sapiens
tccaaataattaggagtggactgtatacaagatgcttcagtcttccttcatccaggaacgtctcagtggtttttaagttttattcatgtcttggatattcttcaatatttacaatagaatccagtttgagaataatgaagatcaagatgtaaacccgctgaaactaggcc

SEQ ID NO: 5378 - DNA, 170 bp, Homo sapiens
ggtagtatctcaggttttgtccctccaaataattaggagtggactgtatacaagatgcttcagtcttccttcatccaggaacgtctcagtggtttttaagttttattcatgtcttggatattcttcaatatttacaatagaatccagtttgagaataatgaagatcaaga

SEQ ID NO: 5379 - DNA, 170 bp, Homo sapiens
gtctgtcattcaccatttgactgcagcttcttctgagatggatgaagagcatggacagctcaatgtcaggtattgcagtttttccctgtactccacatgttaagcaaatggagttaggtttttgtcttttatgagcatacaacttttgacttctattgatcaaggttgag

SEQ ID NO: 5380 - DNA, 170 bp, Homo sapiens
gctgtaagccacagtgagttcagcccccggtctgtcattcaccatttgactgcagcttcttctgagatggatgaagagcatggacagctcaatgtcaggtattgcagtttttccctgtactccacatgttaagcaaatggagttaggtttttgtcttttatgagcataca

SEQ ID NO: 5381 - DNA, 170 bp, Homo sapiens
acttggattgaagaagacgtcttcctggctgtaagccacagtgagttcagcccccggtctgtcattcaccatttgactgcagcttcttctgagatggatgaagagcatggacagctcaatgtcaggtattgcagtttttccctgtactccacatgttaagcaaatggagt

SEQ ID NO: 5382 - DNA, 170 bp, Homo sapiens
cccgctgaaactaggccttctcacttggattgaagaagacgtcttcctggctgtaagccacagtgagttcagcccccggtctgtcattcaccatttgactgcagcttcttctgagatggatgaagagcatggacagctcaatgtcaggtattgcagtttttccctgtact

SEQ ID NO: 5383 - DNA, 170 bp, Homo sapiens
gtttgagaataatgaagatcaagatgtaaacccgctgaaactaggccttctcacttggattgaagaagacgtcttcctggctgtaagccacagtgagttcagcccccggtctgtcattcaccatttgactgcagcttcttctgagatggatgaagagcatggacagctca

SEQ ID NO: 5384 - DNA, 170 bp, Homo sapiens
tcttcaatatttacaatagaatccagtttgagaataatgaagatcaagatgtaaacccgctgaaactaggccttctcacttggattgaagaagacgtcttcctggctgtaagccacagtgagttcagcccccggtctgtcattcaccatttgactgcagcttcttctgag

SEQ ID NO: 5385 - DNA, 170 bp, Homo sapiens
agttttattcatgtcttggatattcttcaatatttacaatagaatccagtttgagaataatgaagatcaagatgtaaacccgctgaaactaggccttctcacttggattgaagaagacgtcttcctggctgtaagccacagtgagttcagcccccggtctgtcattcacc

SEQ ID NO: 5386 - DNA, 170 bp, Homo sapiens
ccaggaacgtctcagtggtttttaagttttattcatgtcttggatattcttcaatatttacaatagaatccagtttgagaataatgaagatcaagatgtaaacccgctgaaactaggccttctcacttggattgaagaagacgtcttcctggctgtaagccacagtgagt

SEQ ID NO: 5387 - DNA, 170 bp, Homo sapiens
ccagatatttaagtacctttggggtgagtatcaaggtgttaggaaagcatgttatgacttacatagatgcttagttcttaagaacatgtacttgtatcttgtcagttcaatattgattgtcaggtcttttaactaccctggaaaaccctaagctttagagtggaattggc

SEQ ID NO: 5388 - DNA, 170 bp, Homo sapiens
gaccaagtcagtagtattacagctggctgatggccagatatttaagtacctttggggtgagtatcaaggtgttaggaaagcatgttatgacttacatagatgcttagttcttaagaacatgtacttgtatcttgtcagttcaatattgattgtcaggtcttttaactacc

SEQ ID NO: 5389 - DNA, 170 bp, Homo sapiens
agtctatgttgcaattccaagaccaagtcagtagtattacagctggctgatggccagatatttaagtacctttggggtgagtatcaaggtgttaggaaagcatgttatgacttacatagatgcttagttcttaagaacatgtacttgtatcttgtcagttcaatattgat

SEQ ID NO: 5390 - DNA, 170 bp, Homo sapiens
agcggtggatggggtcataatcagtctatgttgcaattccaagaccaagtcagtagtattacagctggctgatggccagatatttaagtacctttggggtgagtatcaaggtgttaggaaagcatgttatgacttacatagatgcttagttcttaagaacatgtacttgt

SEQ ID NO: 5391 - DNA, 170 bp, Homo sapiens
tccttttttttgtcagttcatctgcagcggtggatggggtcataatcagtctatgttgcaattccaagaccaagtcagtagtattacagctggctgatggccagatatttaagtacctttggggtgagtatcaaggtgttaggaaagcatgttatgacttacatagatgc

SEQ ID NO: 5392 - DNA, 170 bp, Homo sapiens
tgagaaaaatggtctgtttacactcccttctccttttttttgtcagttcatctgcagcggtggatggggtcataatcagtctatgttgcaattccaagaccaagtcagtagtattacagctggctgatggccagatatttaagtacctttggggtgagtatcaaggtgtt

SEQ ID NO: 5393 - DNA, 170 bp, Homo sapiens
atcagtgaaatgtcactatttttgagaaaaatggtctgtttacactcccttctccttttttttgtcagttcatctgcagcggtggatggggtcataatcagtctatgttgcaattccaagaccaagtcagtagtattacagctggctgatggccagatatttaagtacct

SEQ ID NO: 5394 - DNA, 170 bp, Homo sapiens
caaaaggaaattgttgattttcaaaatcagtgaaatgtcactatttttgagaaaaatggtctgtttacactcccttctccttttttttgtcagttcatctgcagcggtggatggggtcataatcagtctatgttgcaattccaagaccaagtcagtagtattacagctgg

SEQ ID NO: 5395 - DNA, 170 bp, Homo sapiens
tgtattgaagtaggtagtgcagcatcaaaaggaaattgttgattttcaaaatcagtgaaatgtcactatttttgagaaaaatggtctgtttacactcccttctccttttttttgtcagttcatctgcagcggtggatggggtcataatcagtctatgttgcaattccaag

SEQ ID NO: 5396 - DNA, 170 bp, Homo sapiens
tgggtgtgtatatatgtattttgtctacattgtattgaagtaggtagtgcagcatcaaaaggaaattgttgattttcaaaatcagtgaaatgtcactatttttgagaaaaatggtctgtttacactcccttctccttttttttgtcagttcatctgcagcggtggatggg

SEQ ID NO: 5397 - DNA, 170 bp, Homo sapiens
tggccatgattggagaagaggtaggtgaacacggagcaggaaatttacttaaagtagttacccagggactgatggcattaagtagaaagagcgtgggctttggaggtggacttgggtctccactaaatgcctagacaatagtgggaaatgatctcactttcataagccac

SEQ ID NO: 5398 - DNA, 170 bp, Homo sapiens
ccttatccatgcacccagaccgaattggccatgattggagaagaggtaggtgaacacggagcaggaaatttacttaaagtagttacccagggactgatggcattaagtagaaagagcgtgggctttggaggtggacttgggtctccactaaatgcctagacaatagtggg

SEQ ID NO: 5399 - DNA, 170 bp, Homo sapiens
actctggtggatttcctgttcggtttccttatccatgcacccagaccgaattggccatgattggagaagaggtaggtgaacacggagcaggaaatttacttaaagtagttacccagggactgatggcattaagtagaaagagcgtgggctttggaggtggacttgggtct

SEQ ID NO: 5400 - DNA, 170 bp, Homo sapiens
tctctggctattaaaccatggaagaactctggtggatttcctgttcggtttccttatccatgcacccagaccgaattggccatgattggagaagaggtaggtgaacacggagcaggaaatttacttaaagtagttacccagggactgatggcattaagtagaaagagcgt

SEQ ID NO: 5401 - DNA, 170 bp, Homo sapiens
tctgtgaatcttgcagagtcaccttctctggctattaaaccatggaagaactctggtggatttcctgttcggtttccttatccatgcacccagaccgaattggccatgattggagaagaggtaggtgaacacggagcaggaaatttacttaaagtagttacccagggact

SEQ ID NO: 5402 - DNA, 170 bp, Homo sapiens
gagcgcatcagctatttgtgaactagatctgtgaatcttgcagagtcaccttctctggctattaaaccatggaagaactctggtggatttcctgttcggtttccttatccatgcacccagaccgaattggccatgattggagaagaggtaggtgaacacggagcaggaaa

SEQ ID NO: 5403 - DNA, 170 bp, Homo sapiens
tgttgatgttgatggttttttgcaaagagcgcatcagctatttgtgaactagatctgtgaatcttgcagagtcaccttctctggctattaaaccatggaagaactctggtggatttcctgttcggtttccttatccatgcacccagaccgaattggccatgattggagaa

SEQ ID NO: 5404 - DNA, 170 bp, Homo sapiens
tgcatgttaagtgttttagcaaatgttgatgttgatggttttttgcaaagagcgcatcagctatttgtgaactagatctgtgaatcttgcagagtcaccttctctggctattaaaccatggaagaactctggtggatttcctgttcggtttccttatccatgcacccaga

SEQ ID NO: 5405 - DNA, 170 bp, Homo sapiens
gcattagagaaaaaaagtgattgaaattgcatgttaagtgttttagcaaatgttgatgttgatggttttttgcaaagagcgcatcagctatttgtgaactagatctgtgaatcttgcagagtcaccttctctggctattaaaccatggaagaactctggtggatttcctg

SEQ ID NO: 5406 - DNA, 170 bp, Homo sapiens
atatatatataaataaataatgccagcattagagaaaaaaagtgattgaaattgcatgttaagtgttttagcaaatgttgatgttgatggttttttgcaaagagcgcatcagctatttgtgaactagatctgtgaatcttgcagagtcaccttctctggctattaaacca

SEQ ID NO: 5407 - DNA, 170 bp, Homo sapiens
ggtgtcgctttttcatcaatgacattgaggtatcaaggcttggtttggtgttggatccttttcacagtgttagctccgagtaatctagctagctttcacccatgcctctctggccttctcttgcaggttgcgtcaaatatcacgtcatttgcagtatatgatgagttttt

SEQ ID NO: 5408 - DNA, 170 bp, Homo sapiens
aggaatgtgtccttggtctgactgacaggtgtcgctttttcatcaatgacattgaggtatcaaggcttggtttggtgttggatccttttcacagtgttagctccgagtaatctagctagctttcacccatgcctctctggccttctcttgcaggttgcgtcaaatatcac

SEQ ID NO: 5409 - DNA, 170 bp, Homo sapiens
tgtgatttcagttttatttctttgcaggaatgtgtccttggtctgactgacaggtgtcgctttttcatcaatgacattgaggtatcaaggcttggtttggtgttggatccttttcacagtgttagctccgagtaatctagctagctttcacccatgcctctctggccttc

SEQ ID NO: 5410 - DNA, 170 bp, Homo sapiens
aactgatttgagatagaattgcttgtgatttcagttttatttctttgcaggaatgtgtccttggtctgactgacaggtgtcgctttttcatcaatgacattgaggtatcaaggcttggtttggtgttggatccttttcacagtgttagctccgagtaatctagctagctt

SEQ ID NO: 5411 - DNA, 170 bp, Homo sapiens
actatgtgatagaaaaggtaggtttaactgatttgagatagaattgcttgtgatttcagttttatttctttgcaggaatgtgtccttggtctgactgacaggtgtcgctttttcatcaatgacattgaggtatcaaggcttggtttggtgttggatccttttcacagtgt

SEQ ID NO: 5412 - DNA, 170 bp, Homo sapiens
aggtgtgaaatcatagggtggtagaactatgtgatagaaaaggtaggtttaactgatttgagatagaattgcttgtgatttcagttttatttctttgcaggaatgtgtccttggtctgactgacaggtgtcgctttttcatcaatgacattgaggtatcaaggcttggtt

SEQ ID NO: 5413 - DNA, 170 bp, Homo sapiens
ctttagtcctgattacaggaacttaggtgtgaaatcatagggtggtagaactatgtgatagaaaaggtaggtttaactgatttgagatagaattgcttgtgatttcagttttatttctttgcaggaatgtgtccttggtctgactgacaggtgtcgctttttcatcaatg

SEQ ID NO: 5414 - DNA, 170 bp, Homo sapiens
ctgagggatgcttcatttaaaagtaagttttcaatgtataaaacagaaatggtcccttctccaatgtcttttggagtcttgatgactttttgaattcttcatttattttggctttttatcaaggagtcctaggctggagaaaatctttagagttattttacttagaccct

SEQ ID NO: 5415 - DNA, 170 bp, Homo sapiens
cccatacctgccagtgtttttgcctgagggatgcttcatttaaaagtaagttttcaatgtataaaacagaaatggtcccttctccaatgtcttttggagtcttgatgactttttgaattcttcatttattttggctttttatcaaggagtcctaggctggagaaaatctt

SEQ ID NO: 5416 - DNA, 170 bp, Homo sapiens
tgagtttttattgttgacaacccattcccatacctgccagtgtttttgcctgagggatgcttcatttaaaagtaagttttcaatgtataaaacagaaatggtcccttctccaatgtcttttggagtcttgatgactttttgaattcttcatttattttggctttttatca

SEQ ID NO: 5417 - DNA, 170 bp, Homo sapiens
atatcacgtcatttgcagtatatgatgagtttttattgttgacaacccattcccatacctgccagtgtttttgcctgagggatgcttcatttaaaagtaagttttcaatgtataaaacagaaatggtcccttctccaatgtcttttggagtcttgatgactttttgaatt

SEQ ID NO: 5418 - DNA, 170 bp, Homo sapiens
gccttctcttgcaggttgcgtcaaatatcacgtcatttgcagtatatgatgagtttttattgttgacaacccattcccatacctgccagtgtttttgcctgagggatgcttcatttaaaagtaagttttcaatgtataaaacagaaatggtcccttctccaatgtctttt

SEQ ID NO: 5419 - DNA, 170 bp, Homo sapiens
gctttcacccatgcctctctggccttctcttgcaggttgcgtcaaatatcacgtcatttgcagtatatgatgagtttttattgttgacaacccattcccatacctgccagtgtttttgcctgagggatgcttcatttaaaagtaagttttcaatgtataaaacagaaatg

SEQ ID NO: 5420 - DNA, 170 bp, Homo sapiens
cagtgttagctccgagtaatctagctagctttcacccatgcctctctggccttctcttgcaggttgcgtcaaatatcacgtcatttgcagtatatgatgagtttttattgttgacaacccattcccatacctgccagtgtttttgcctgagggatgcttcatttaaaagt

SEQ ID NO: 5421 - DNA, 170 bp, Homo sapiens
ggcttggtttggtgttggatccttttcacagtgttagctccgagtaatctagctagctttcacccatgcctctctggccttctcttgcaggttgcgtcaaatatcacgtcatttgcagtatatgatgagtttttattgttgacaacccattcccatacctgccagtgttt

SEQ ID NO: 5422 - DNA, 170 bp, Homo sapiens
tcatcaatgacattgaggtatcaaggcttggtttggtgttggatccttttcacagtgttagctccgagtaatctagctagctttcacccatgcctctctggccttctcttgcaggttgcgtcaaatatcacgtcatttgcagtatatgatgagtttttattgttgacaac

SEQ ID NO: 5423 - DNA, 170 bp, Homo sapiens
ttggtctgactgacaggtgtcgctttttcatcaatgacattgaggtatcaaggcttggtttggtgttggatccttttcacagtgttagctccgagtaatctagctagctttcacccatgcctctctggccttctcttgcaggttgcgtcaaatatcacgtcatttgcagt

SEQ ID NO: 5424 - DNA, 170 bp, Homo sapiens
tcactgttgtgccccaggacacaaagcttgtattacaggtaagctggtttttcagacaagatagatagtctgattgtcattcagccaagtaccaagcataattcttgcaggttgtattttaggctttcttattctttgtatcgtttattgtaaacctttccttgatagtt

SEQ ID NO: 5425 - DNA, 170 bp, Homo sapiens
gagaggggttcacggattgtcactgttgtgccccaggacacaaagcttgtattacaggtaagctggtttttcagacaagatagatagtctgattgtcattcagccaagtaccaagcataattcttgcaggttgtattttaggctttcttattctttgtatcgtttattgt

SEQ ID NO: 5426 - DNA, 170 bp, Homo sapiens
tggggaagttctgcggaaagtggagaggggttcacggattgtcactgttgtgccccaggacacaaagcttgtattacaggtaagctggtttttcagacaagatagatagtctgattgtcattcagccaagtaccaagcataattcttgcaggttgtattttaggctttct

SEQ ID NO: 5427 - DNA, 170 bp, Homo sapiens
cggcctgagcagcaatcatgtgtcccatggggaagttctgcggaaagtggagaggggttcacggattgtcactgttgtgccccaggacacaaagcttgtattacaggtaagctggtttttcagacaagatagatagtctgattgtcattcagccaagtaccaagcataat

SEQ ID NO: 5428 - DNA, 170 bp, Homo sapiens
atggtgtgtttagcattacaggccggcctgagcagcaatcatgtgtcccatggggaagttctgcggaaagtggagaggggttcacggattgtcactgttgtgccccaggacacaaagcttgtattacaggtaagctggtttttcagacaagatagatagtctgattgtca

SEQ ID NO: 5429 - DNA, 170 bp, Homo sapiens
gcttgttgtgataattaaggcttattagttaatggtgtgtttagcattacaggccggcctgagcagcaatcatgtgtcccatggggaagttctgcggaaagtggagaggggttcacggattgtcactgttgtgccccaggacacaaagcttgtattacaggtaagctggt

SEQ ID NO: 5430 - DNA, 170 bp, Homo sapiens
tttcaattgcagttaatggagagtggcttgttgtgataattaaggcttattagttaatggtgtgtttagcattacaggccggcctgagcagcaatcatgtgtcccatggggaagttctgcggaaagtggagaggggttcacggattgtcactgttgtgccccaggacaca

SEQ ID NO: 5431 - DNA, 170 bp, Homo sapiens
tcttctatttcacataatgtgtgcggtttcaattgcagttaatggagagtggcttgttgtgataattaaggcttattagttaatggtgtgtttagcattacaggccggcctgagcagcaatcatgtgtcccatggggaagttctgcggaaagtggagaggggttcacgga

SEQ ID NO: 5432 - DNA, 170 bp, Homo sapiens
aggcacatggttgttatttgttctcttctatttcacataatgtgtgcggtttcaattgcagttaatggagagtggcttgttgtgataattaaggcttattagttaatggtgtgtttagcattacaggccggcctgagcagcaatcatgtgtcccatggggaagttctgcg

SEQ ID NO: 5433 - DNA, 170 bp, Homo sapiens
agtcttgaggttcagtgggagagctaaggcacatggttgttatttgttctcttctatttcacataatgtgtgcggtttcaattgcagttaatggagagtggcttgttgtgataattaaggcttattagttaatggtgtgtttagcattacaggccggcctgagcagcaat

SEQ ID NO: 5434 - DNA, 170 bp, Homo sapiens
tttagctcagattcggaagtggttggacaagtaagtgccattgtactgtttgcgactagttagcttgtgatttatgtgtgaagacaataagtattttattacaatttcgagaacttaaaattatgaaaagccctcattacctatatcatcaatcagattcttagaggctc

SEQ ID NO: 5435 - DNA, 170 bp, Homo sapiens
tagaagttgttcatcatcgagccctggttttagctcagattcggaagtggttggacaagtaagtgccattgtactgtttgcgactagttagcttgtgatttatgtgtgaagacaataagtattttattacaatttcgagaacttaaaattatgaaaagccctcattacct

SEQ ID NO: 5436 - DNA, 170 bp, Homo sapiens
ttaagatgccaaggggaaacttagaagttgttcatcatcgagccctggttttagctcagattcggaagtggttggacaagtaagtgccattgtactgtttgcgactagttagcttgtgatttatgtgtgaagacaataagtattttattacaatttcgagaacttaaaat

SEQ ID NO: 5437 - DNA, 170 bp, Homo sapiens
taattaaaaatgttactgctttaatttatttaagatgccaaggggaaacttagaagttgttcatcatcgagccctggttttagctcagattcggaagtggttggacaagtaagtgccattgtactgtttgcgactagttagcttgtgatttatgtgtgaagacaataagt

SEQ ID NO: 5438 - DNA, 170 bp, Homo sapiens
cctggctatttaaatgttttctacttaattaaaaatgttactgctttaatttatttaagatgccaaggggaaacttagaagttgttcatcatcgagccctggttttagctcagattcggaagtggttggacaagtaagtgccattgtactgtttgcgactagttagcttg

SEQ ID NO: 5439 - DNA, 170 bp, Homo sapiens
tgtgaagagttaggtaaaatggtgtatcctggctatttaaatgttttctacttaattaaaaatgttactgctttaatttatttaagatgccaaggggaaacttagaagttgttcatcatcgagccctggttttagctcagattcggaagtggttggacaagtaagtgcca

SEQ ID NO: 5440 - DNA, 170 bp, Homo sapiens
agagagttgtggtaattctctgtgaagagttaggtaaaatggtgtatcctggctatttaaatgttttctacttaattaaaaatgttactgctttaatttatttaagatgccaaggggaaacttagaagttgttcatcatcgagccctggttttagctcagattcggaagt

SEQ ID NO: 5441 - DNA, 170 bp, Homo sapiens
ttctgctaaaagtgtgctgattttagagagttgtggtaattctctgtgaagagttaggtaaaatggtgtatcctggctatttaaatgttttctacttaattaaaaatgttactgctttaatttatttaagatgccaaggggaaacttagaagttgttcatcatcgagccc

SEQ ID NO: 5442 - DNA, 170 bp, Homo sapiens
tggagacgtcatactctgcagtctcagcacacaacaggtaagtggaagactccagtgaggggggagtctcaagcatcctcaaataggttacttgctatttgtggaagttttcaaatcagtagccataatagttacacttttgctaattaatttttgcattatatatttct

SEQ ID NO: 5443 - DNA, 170 bp, Homo sapiens
gagtctgtgtgtgtggccacagcctctggagacgtcatactctgcagtctcagcacacaacaggtaagtggaagactccagtgaggggggagtctcaagcatcctcaaataggttacttgctatttgtggaagttttcaaatcagtagccataatagttacacttttgct

SEQ ID NO: 5444 - DNA, 170 bp, Homo sapiens
agtttggattttcatctagaaaaaatatttttgaaagcttttatgtaataaaagaagcattaaaaagtatttctggaaatgttatcaattattcttgaaagtagactgggttaatttgcttgtgtttactttggtgaaaggtgaaaaatgaagtttctttggtggcagaa

SEQ ID NO: 5445 - DNA, 170 bp, Homo sapiens
tggtgttcaggacttgctggatcaggagtctgtgtgtgtggccacagcctctggagacgtcatactctgcagtctcagcacacaacaggtaagtggaagactccagtgaggggggagtctcaagcatcctcaaataggttacttgctatttgtggaagttttcaaatcag

SEQ ID NO: 5446 - DNA, 170 bp, Homo sapiens
ccagaggatggaagtggccgcattgttggtgttcaggacttgctggatcaggagtctgtgtgtgtggccacagcctctggagacgtcatactctgcagtctcagcacacaacaggtaagtggaagactccagtgaggggggagtctcaagcatcctcaaataggttactt

SEQ ID NO: 5447 - DNA, 170 bp, Homo sapiens
agtttctttggtggcagaaggctttctcccagaggatggaagtggccgcattgttggtgttcaggacttgctggatcaggagtctgtgtgtgtggccacagcctctggagacgtcatactctgcagtctcagcacacaacaggtaagtggaagactccagtgagggggga

SEQ ID NO: 5448 - DNA, 170 bp, Homo sapiens
ttactttggtgaaaggtgaaaaatgaagtttctttggtggcagaaggctttctcccagaggatggaagtggccgcattgttggtgttcaggacttgctggatcaggagtctgtgtgtgtggccacagcctctggagacgtcatactctgcagtctcagcacacaacaggt

SEQ ID NO: 5449 - DNA, 170 bp, Homo sapiens
agactgggttaatttgcttgtgtttactttggtgaaaggtgaaaaatgaagtttctttggtggcagaaggctttctcccagaggatggaagtggccgcattgttggtgttcaggacttgctggatcaggagtctgtgtgtgtggccacagcctctggagacgtcatactc

SEQ ID NO: 5450 - DNA, 170 bp, Homo sapiens
ggaaatgttatcaattattcttgaaagtagactgggttaatttgcttgtgtttactttggtgaaaggtgaaaaatgaagtttctttggtggcagaaggctttctcccagaggatggaagtggccgcattgttggtgttcaggacttgctggatcaggagtctgtgtgtgt

SEQ ID NO: 5451 - DNA, 170 bp, Homo sapiens
agaagcattaaaaagtatttctggaaatgttatcaattattcttgaaagtagactgggttaatttgcttgtgtttactttggtgaaaggtgaaaaatgaagtttctttggtggcagaaggctttctcccagaggatggaagtggccgcattgttggtgttcaggacttgc

SEQ ID NO: 5452 - DNA, 170 bp, Homo sapiens
tttttgaaagcttttatgtaataaaagaagcattaaaaagtatttctggaaatgttatcaattattcttgaaagtagactgggttaatttgcttgtgtttactttggtgaaaggtgaaaaatgaagtttctttggtggcagaaggctttctcccagaggatggaagtggc

SEQ ID NO: 5453 - DNA, 170 bp, Homo sapiens
ctgatttatgatcataaccctaaggtaactttctaagctgtcatttactctagcttactttgtacttaaactaatatgatctgaacgaagatgttttgtcctttttttggtaggtgtttcttggaaatgtggaaaccttcattaaacagatagattctgtgaatcatatt

SEQ ID NO: 5454 - DNA, 170 bp, Homo sapiens
atgagaaagctgagaatcaatctcaatctgatttatgatcataaccctaaggtaactttctaagctgtcatttactctagcttactttgtacttaaactaatatgatctgaacgaagatgttttgtcctttttttggtaggtgtttcttggaaatgtggaaaccttcatt

SEQ ID NO: 5455 - DNA, 170 bp, Homo sapiens
tgtttaaagaggcatttgaatgcatgagaaagctgagaatcaatctcaatctgatttatgatcataaccctaaggtaactttctaagctgtcatttactctagcttactttgtacttaaactaatatgatctgaacgaagatgttttgtcctttttttggtaggtgtttc

SEQ ID NO: 5456 - DNA, 170 bp, Homo sapiens
tctttctctgtcttctcacagacttatgtttaaagaggcatttgaatgcatgagaaagctgagaatcaatctcaatctgatttatgatcataaccctaaggtaactttctaagctgtcatttactctagcttactttgtacttaaactaatatgatctgaacgaagatgt

SEQ ID NO: 5457 - DNA, 170 bp, Homo sapiens
cagtttttgtgaatatcttttctattctttctctgtcttctcacagacttatgtttaaagaggcatttgaatgcatgagaaagctgagaatcaatctcaatctgatttatgatcataaccctaaggtaactttctaagctgtcatttactctagcttactttgtacttaa

SEQ ID NO: 5458 - DNA, 170 bp, Homo sapiens
tatgctgggcccatggagctcagtttttgtgaatatcttttctattctttctctgtcttctcacagacttatgtttaaagaggcatttgaatgcatgagaaagctgagaatcaatctcaatctgatttatgatcataaccctaaggtaactttctaagctgtcatttact

SEQ ID NO: 5459 - DNA, 170 bp, Homo sapiens
ttataactggtttgtatcataatgaaaatatgctgggcccatggagctcagtttttgtgaatatcttttctattctttctctgtcttctcacagacttatgtttaaagaggcatttgaatgcatgagaaagctgagaatcaatctcaatctgatttatgatcataaccct

SEQ ID NO: 5460 - DNA, 170 bp, Homo sapiens
ttggcattggggctgtaatctgattataactggtttgtatcataatgaaaatatgctgggcccatggagctcagtttttgtgaatatcttttctattctttctctgtcttctcacagacttatgtttaaagaggcatttgaatgcatgagaaagctgagaatcaatctca

SEQ ID NO: 5461 - DNA, 170 bp, Homo sapiens
ttcagagtagaaatccagtgatagcagcttggcattggggctgtaatctgattataactggtttgtatcataatgaaaatatgctgggcccatggagctcagtttttgtgaatatcttttctattctttctctgtcttctcacagacttatgtttaaagaggcatttgaa

SEQ ID NO: 5462 - DNA, 170 bp, Homo sapiens
aacttgttttttacagaattgaagtaagtattttgaataattcatgtgtatcttttccatagttttctctcttcttgttaaggaaatcaagcataaatagctagagaagaaaaattccttactgttcatttttaaaaattgctataactcttagatgccagttggttttt

SEQ ID NO: 5463 - DNA, 170 bp, Homo sapiens
acagatagattctgtgaatcatattaacttgttttttacagaattgaagtaagtattttgaataattcatgtgtatcttttccatagttttctctcttcttgttaaggaaatcaagcataaatagctagagaagaaaaattccttactgttcatttttaaaaattgctat

SEQ ID NO: 5464 - DNA, 170 bp, Homo sapiens
aaatgtggaaaccttcattaaacagatagattctgtgaatcatattaacttgttttttacagaattgaagtaagtattttgaataattcatgtgtatcttttccatagttttctctcttcttgttaaggaaatcaagcataaatagctagagaagaaaaattccttactg

SEQ ID NO: 5465 - DNA, 170 bp, Homo sapiens
atgttttgtcctttttttggtaggtgtttcttggaaatgtggaaaccttcattaaacagatagattctgtgaatcatattaacttgttttttacagaattgaagtaagtattttgaataattcatgtgtatcttttccatagttttctctcttcttgttaaggaaatcaa

SEQ ID NO: 5466 - DNA, 170 bp, Homo sapiens
aatatgatctgaacgaagatgttttgtcctttttttggtaggtgtttcttggaaatgtggaaaccttcattaaacagatagattctgtgaatcatattaacttgttttttacagaattgaagtaagtattttgaataattcatgtgtatcttttccatagttttctctct

SEQ ID NO: 5467 - DNA, 170 bp, Homo sapiens
tagcttactttgtacttaaactaatatgatctgaacgaagatgttttgtcctttttttggtaggtgtttcttggaaatgtggaaaccttcattaaacagatagattctgtgaatcatattaacttgttttttacagaattgaagtaagtattttgaataattcatgtgta

SEQ ID NO: 5468 - DNA, 170 bp, Homo sapiens
aggtaactttctaagctgtcatttactctagcttactttgtacttaaactaatatgatctgaacgaagatgttttgtcctttttttggtaggtgtttcttggaaatgtggaaaccttcattaaacagatagattctgtgaatcatattaacttgttttttacagaattga

SEQ ID NO: 5469 - DNA, 170 bp, Homo sapiens
tctcaatctgatttatgatcataaccctaaggtaactttctaagctgtcatttactctagcttactttgtacttaaactaatatgatctgaacgaagatgttttgtcctttttttggtaggtgtttcttggaaatgtggaaaccttcattaaacagatagattctgtgaa

SEQ ID NO: 5470 - DNA, 170 bp, Homo sapiens
gcatgagaaagctgagaatcaatctcaatctgatttatgatcataaccctaaggtaactttctaagctgtcatttactctagcttactttgtacttaaactaatatgatctgaacgaagatgttttgtcctttttttggtaggtgtttcttggaaatgtggaaaccttca

SEQ ID NO: 5471 - DNA, 170 bp, Homo sapiens
gagcagtcatggagagcataaatcctcataagtatgtatgctgtcaccaggtggcatcctttgaaaaaccgaagtgtgtagttgtccttgtccagcctacttacctttctcattctggtgttcttcacttattacctcagatactgcctatccatacttacatctcatgt

SEQ ID NO: 5472 - DNA, 170 bp, Homo sapiens
agaccttgtctgcgatgctatgagagcagtcatggagagcataaatcctcataagtatgtatgctgtcaccaggtggcatcctttgaaaaaccgaagtgtgtagttgtccttgtccagcctacttacctttctcattctggtgttcttcacttattacctcagatactgc

SEQ ID NO: 5473 - DNA, 170 bp, Homo sapiens
tgttttatttctcaatatttttataattcaactcttttccaaaagtcatttttatttatcatcatcagcatgccaggtgtatgttagtaatttgatcgctgggctacatgttctgttgatgaccattccatacacacctgttcttagagaagaagatgtcacgaagacca

SEQ ID NO: 5474 - DNA, 170 bp, Homo sapiens
tccagggatcctgacgggaataaaatagaccttgtctgcgatgctatgagagcagtcatggagagcataaatcctcataagtatgtatgctgtcaccaggtggcatcctttgaaaaaccgaagtgtgtagttgtccttgtccagcctacttacctttctcattctggtgt

SEQ ID NO: 5475 - DNA, 170 bp, Homo sapiens
gcaccagttaccagcagtgtctacctgtccagggatcctgacgggaataaaatagaccttgtctgcgatgctatgagagcagtcatggagagcataaatcctcataagtatgtatgctgtcaccaggtggcatcctttgaaaaaccgaagtgtgtagttgtccttgtcca

SEQ ID NO: 5476 - DNA, 170 bp, Homo sapiens
gatgtcacgaagaccatgtaccctgcaccagttaccagcagtgtctacctgtccagggatcctgacgggaataaaatagaccttgtctgcgatgctatgagagcagtcatggagagcataaatcctcataagtatgtatgctgtcaccaggtggcatcctttgaaaaacc

SEQ ID NO: 5477 - DNA, 170 bp, Homo sapiens
ccatacacacctgttcttagagaagaagatgtcacgaagaccatgtaccctgcaccagttaccagcagtgtctacctgtccagggatcctgacgggaataaaatagaccttgtctgcgatgctatgagagcagtcatggagagcataaatcctcataagtatgtatgctg

SEQ ID NO: 5478 - DNA, 170 bp, Homo sapiens
ggctacatgttctgttgatgaccattccatacacacctgttcttagagaagaagatgtcacgaagaccatgtaccctgcaccagttaccagcagtgtctacctgtccagggatcctgacgggaataaaatagaccttgtctgcgatgctatgagagcagtcatggagagc

SEQ ID NO: 5479 - DNA, 170 bp, Homo sapiens
gtatgttagtaatttgatcgctgggctacatgttctgttgatgaccattccatacacacctgttcttagagaagaagatgtcacgaagaccatgtaccctgcaccagttaccagcagtgtctacctgtccagggatcctgacgggaataaaatagaccttgtctgcgatg

SEQ ID NO: 5480 - DNA, 170 bp, Homo sapiens
ttatttatcatcatcagcatgccaggtgtatgttagtaatttgatcgctgggctacatgttctgttgatgaccattccatacacacctgttcttagagaagaagatgtcacgaagaccatgtaccctgcaccagttaccagcagtgtctacctgtccagggatcctgacg

SEQ ID NO: 5481 - DNA, 170 bp, Homo sapiens
ttcaactcttttccaaaagtcatttttatttatcatcatcagcatgccaggtgtatgttagtaatttgatcgctgggctacatgttctgttgatgaccattccatacacacctgttcttagagaagaagatgtcacgaagaccatgtaccctgcaccagttaccagcagt

SEQ ID NO: 5482 - DNA, 170 bp, Homo sapiens
actggaaattgtactgcaaaaagtacacgagcttcaaggtagagatccgctcacagagaaagtgcttaaggtggccgtgactgctactagtcttctgcaggtgacaatcaccatgtcattgccacaccacagatttaacatgtgactttttagttgccattttaagaccc

SEQ ID NO: 5483 - DNA, 170 bp, Homo sapiens
tcatgtaaagaagacaaccccagaactggaaattgtactgcaaaaagtacacgagcttcaaggtagagatccgctcacagagaaagtgcttaaggtggccgtgactgctactagtcttctgcaggtgacaatcaccatgtcattgccacaccacagatttaacatgtgac

SEQ ID NO: 5484 - DNA, 170 bp, Homo sapiens
tcagatactgcctatccatacttacatctcatgtaaagaagacaaccccagaactggaaattgtactgcaaaaagtacacgagcttcaaggtagagatccgctcacagagaaagtgcttaaggtggccgtgactgctactagtcttctgcaggtgacaatcaccatgtca

SEQ ID NO: 5485 - DNA, 170 bp, Homo sapiens
tctggtgttcttcacttattacctcagatactgcctatccatacttacatctcatgtaaagaagacaaccccagaactggaaattgtactgcaaaaagtacacgagcttcaaggtagagatccgctcacagagaaagtgcttaaggtggccgtgactgctactagtcttc

SEQ ID NO: 5486 - DNA, 170 bp, Homo sapiens
gtccagcctacttacctttctcattctggtgttcttcacttattacctcagatactgcctatccatacttacatctcatgtaaagaagacaaccccagaactggaaattgtactgcaaaaagtacacgagcttcaaggtagagatccgctcacagagaaagtgcttaagg

SEQ ID NO: 5487 - DNA, 170 bp, Homo sapiens
aaaaaccgaagtgtgtagttgtccttgtccagcctacttacctttctcattctggtgttcttcacttattacctcagatactgcctatccatacttacatctcatgtaaagaagacaaccccagaactggaaattgtactgcaaaaagtacacgagcttcaaggtagaga

SEQ ID NO: 5488 - DNA, 170 bp, Homo sapiens
tgtcaccaggtggcatcctttgaaaaaccgaagtgtgtagttgtccttgtccagcctacttacctttctcattctggtgttcttcacttattacctcagatactgcctatccatacttacatctcatgtaaagaagacaaccccagaactggaaattgtactgcaaaaag

SEQ ID NO: 5489 - DNA, 170 bp, Homo sapiens
gagagcataaatcctcataagtatgtatgctgtcaccaggtggcatcctttgaaaaaccgaagtgtgtagttgtccttgtccagcctacttacctttctcattctggtgttcttcacttattacctcagatactgcctatccatacttacatctcatgtaaagaagacaa

SEQ ID NO: 5490 - DNA, 170 bp, Homo sapiens
catggtagctgagaagtcacagaaggtatgtggagttcttacttttatgccatttggttcttgtttatataatgatagtgtgaaaccctgcttctggtagtgcagtagcttttctgctatcactctgtgagtgcagggctggagacagatctgtgagtttctagggccca

SEQ ID NO: 5491 - DNA, 170 bp, Homo sapiens
acctatgactttgatttggtcctcatggtagctgagaagtcacagaaggtatgtggagttcttacttttatgccatttggttcttgtttatataatgatagtgtgaaaccctgcttctggtagtgcagtagcttttctgctatcactctgtgagtgcagggctggagaca

SEQ ID NO: 5492 - DNA, 170 bp, Homo sapiens
tattcttctgatgtccagttctattgagaaaaatttattgtctttttggttatgttgttaggtctgtggattttttccccaaatgattgtgttctgttttgttttctaaacactgttaggaaatgctccctctgatcctgatgctgtgagtgctgaagaggccttgaaat

SEQ ID NO: 5493 - DNA, 170 bp, Homo sapiens
tatataaaagtatcagaagtatatattcttctgatgtccagttctattgagaaaaatttattgtctttttggttatgttgttaggtctgtggattttttccccaaatgattgtgttctgttttgttttctaaacactgttaggaaatgctccctctgatcctgatgctgt

SEQ ID NO: 5494 - DNA, 170 bp, Homo sapiens
tgaattatatgatcattctcttggcacctatgactttgatttggtcctcatggtagctgagaagtcacagaaggtatgtggagttcttacttttatgccatttggttcttgtttatataatgatagtgtgaaaccctgcttctggtagtgcagtagcttttctgctatca

SEQ ID NO: 5495 - DNA, 170 bp, Homo sapiens
aatatttgctgcatctggtagatgttaatgaattatatgatcattctcttggcacctatgactttgatttggtcctcatggtagctgagaagtcacagaaggtatgtggagttcttacttttatgccatttggttcttgtttatataatgatagtgtgaaaccctgcttc

SEQ ID NO: 5496 - DNA, 170 bp, Homo sapiens
gtgctgaagaggccttgaaatatttgctgcatctggtagatgttaatgaattatatgatcattctcttggcacctatgactttgatttggtcctcatggtagctgagaagtcacagaaggtatgtggagttcttacttttatgccatttggttcttgtttatataatgat

SEQ ID NO: 5497 - DNA, 170 bp, Homo sapiens
gctccctctgatcctgatgctgtgagtgctgaagaggccttgaaatatttgctgcatctggtagatgttaatgaattatatgatcattctcttggcacctatgactttgatttggtcctcatggtagctgagaagtcacagaaggtatgtggagttcttacttttatgcc

SEQ ID NO: 5498 - DNA, 170 bp, Homo sapiens
ttttgttttctaaacactgttaggaaatgctccctctgatcctgatgctgtgagtgctgaagaggccttgaaatatttgctgcatctggtagatgttaatgaattatatgatcattctcttggcacctatgactttgatttggtcctcatggtagctgagaagtcacaga

SEQ ID NO: 5499 - DNA, 170 bp, Homo sapiens
tccccaaatgattgtgttctgttttgttttctaaacactgttaggaaatgctccctctgatcctgatgctgtgagtgctgaagaggccttgaaatatttgctgcatctggtagatgttaatgaattatatgatcattctcttggcacctatgactttgatttggtcctca

SEQ ID NO: 5500 - DNA, 170 bp, Homo sapiens
atgttgttaggtctgtggattttttccccaaatgattgtgttctgttttgttttctaaacactgttaggaaatgctccctctgatcctgatgctgtgagtgctgaagaggccttgaaatatttgctgcatctggtagatgttaatgaattatatgatcattctcttggca

SEQ ID NO: 5501 - DNA, 170 bp, Homo sapiens
ttgagaaaaatttattgtctttttggttatgttgttaggtctgtggattttttccccaaatgattgtgttctgttttgttttctaaacactgttaggaaatgctccctctgatcctgatgctgtgagtgctgaagaggccttgaaatatttgctgcatctggtagatgtt

SEQ ID NO: 5502 - DNA, 170 bp, Homo sapiens
tggccacctcagcaaatgtggtaagtgtggggattagtatgtttatctctacttcagatcttctttggaactaggcaaggtataaattaaactgttagtttagacagtgactgatttcacttcccactcctgaaaactctaacaattatgtatgctcacgttattttgtc

SEQ ID NO: 5503 - DNA, 170 bp, Homo sapiens
caaatacttgaaacgatatgaaaaagccattggccacctcagcaaatgtggtaagtgtggggattagtatgtttatctctacttcagatcttctttggaactaggcaaggtataaattaaactgttagtttagacagtgactgatttcacttcccactcctgaaaactct

SEQ ID NO: 5504 - DNA, 170 bp, Homo sapiens
atcagcggtttactatagacaaatacttgaaacgatatgaaaaagccattggccacctcagcaaatgtggtaagtgtggggattagtatgtttatctctacttcagatcttctttggaactaggcaaggtataaattaaactgttagtttagacagtgactgatttcact

SEQ ID NO: 5505 - DNA, 170 bp, Homo sapiens
aatacacttaagaaaatggaaactaattatcagcggtttactatagacaaatacttgaaacgatatgaaaaagccattggccacctcagcaaatgtggtaagtgtggggattagtatgtttatctctacttcagatcttctttggaactaggcaaggtataaattaaact

SEQ ID NO: 5506 - DNA, 170 bp, Homo sapiens
caaagaatatcttccatttcttaatacacttaagaaaatggaaactaattatcagcggtttactatagacaaatacttgaaacgatatgaaaaagccattggccacctcagcaaatgtggtaagtgtggggattagtatgtttatctctacttcagatcttctttggaac

SEQ ID NO: 5507 - DNA, 170 bp, Homo sapiens
agttctcattaatcatttttttaggatcccaaagaatatcttccatttcttaatacacttaagaaaatggaaactaattatcagcggtttactatagacaaatacttgaaacgatatgaaaaagccattggccacctcagcaaatgtggtaagtgtggggattagtatgt

SEQ ID NO: 5508 - DNA, 170 bp, Homo sapiens
tcctatatatgaatatcacaagtaataaagttctcattaatcatttttttaggatcccaaagaatatcttccatttcttaatacacttaagaaaatggaaactaattatcagcggtttactatagacaaatacttgaaacgatatgaaaaagccattggccacctcagca

SEQ ID NO: 5509 - DNA, 170 bp, Homo sapiens
atgtaaatgctagtttctattcctatatatgaatatcacaagtaataaagttctcattaatcatttttttaggatcccaaagaatatcttccatttcttaatacacttaagaaaatggaaactaattatcagcggtttactatagacaaatacttgaaacgatatgaaaa

SEQ ID NO: 5510 - DNA, 170 bp, Homo sapiens
atgtagctttgggtttattgctatatgtaaatgctagtttctattcctatatatgaatatcacaagtaataaagttctcattaatcatttttttaggatcccaaagaatatcttccatttcttaatacacttaagaaaatggaaactaattatcagcggtttactataga

SEQ ID NO: 5511 - DNA, 170 bp, Homo sapiens
gttaatatataatacacatttaaaaattatgtagctttgggtttattgctatatgtaaatgctagtttctattcctatatatgaatatcacaagtaataaagttctcattaatcatttttttaggatcccaaagaatatcttccatttcttaatacacttaagaaaatgg

SEQ ID NO: 5512 - DNA, 170 bp, Homo sapiens
agttatattcaccaagctcacaacagtaccaggtatgtggtatgtgaaaatgaggctctcctggttttgctttttgctttagtaggaaaggagtgaggatcctaagttcataacaccatccttggcttcaaaatttatcttaaaactaattagcctcaatttgaacttct

SEQ ID NO: 5513 - DNA, 170 bp, Homo sapiens
aaacttgtataacgaagctctgaagttatattcaccaagctcacaacagtaccaggtatgtggtatgtgaaaatgaggctctcctggttttgctttttgctttagtaggaaaggagtgaggatcctaagttcataacaccatccttggcttcaaaatttatcttaaaact

SEQ ID NO: 5514 - DNA, 170 bp, Homo sapiens
ccagaatgcttaaacttgataaaagataaaaacttgtataacgaagctctgaagttatattcaccaagctcacaacagtaccaggtatgtggtatgtgaaaatgaggctctcctggttttgctttttgctttagtaggaaaggagtgaggatcctaagttcataacacca

SEQ ID NO: 5515 - DNA, 170 bp, Homo sapiens
tcctgcaggacctgagtacttcccagaatgcttaaacttgataaaagataaaaacttgtataacgaagctctgaagttatattcaccaagctcacaacagtaccaggtatgtggtatgtgaaaatgaggctctcctggttttgctttttgctttagtaggaaaggagtga

SEQ ID NO: 5516 - DNA, 170 bp, Homo sapiens
aagcctgtctttgtgtgaatctttttcctgcaggacctgagtacttcccagaatgcttaaacttgataaaagataaaaacttgtataacgaagctctgaagttatattcaccaagctcacaacagtaccaggtatgtggtatgtgaaaatgaggctctcctggttttgct

SEQ ID NO: 5517 - DNA, 170 bp, Homo sapiens
gaagtccattatgcttcccatgtcttaagcctgtctttgtgtgaatctttttcctgcaggacctgagtacttcccagaatgcttaaacttgataaaagataaaaacttgtataacgaagctctgaagttatattcaccaagctcacaacagtaccaggtatgtggtatgt

SEQ ID NO: 5518 - DNA, 170 bp, Homo sapiens
tgtttggtgaccattggtataaatgaagtccattatgcttcccatgtcttaagcctgtctttgtgtgaatctttttcctgcaggacctgagtacttcccagaatgcttaaacttgataaaagataaaaacttgtataacgaagctctgaagttatattcaccaagctcac

SEQ ID NO: 5519 - DNA, 170 bp, Homo sapiens
ggtcttaaaaagttcctcatttattttgtttggtgaccattggtataaatgaagtccattatgcttcccatgtcttaagcctgtctttgtgtgaatctttttcctgcaggacctgagtacttcccagaatgcttaaacttgataaaagataaaaacttgtataacgaagc

SEQ ID NO: 5520 - DNA, 170 bp, Homo sapiens
cccattcttcagattctctgattatttaggtcttaaaaagttcctcatttattttgtttggtgaccattggtataaatgaagtccattatgcttcccatgtcttaagcctgtctttgtgtgaatctttttcctgcaggacctgagtacttcccagaatgcttaaacttga

SEQ ID NO: 5521 - DNA, 170 bp, Homo sapiens
cctcggcagaactctggcaggtaagtacaatcatttatatgtttacatctacaaaggttttaaaaaatttatttcttttgtttggtaattttgcaaataaatttagggcagaatactctgagacagtcttgttctcactgataaaaattaatttagaatgctttaaagga

SEQ ID NO: 5522 - DNA, 170 bp, Homo sapiens
actttaccaaagaccagctggtgggcctcggcagaactctggcaggtaagtacaatcatttatatgtttacatctacaaaggttttaaaaaatttatttcttttgtttggtaattttgcaaataaatttagggcagaatactctgagacagtcttgttctcactgataaa

SEQ ID NO: 5523 - DNA, 170 bp, Homo sapiens
agctacactggagctttagagaaatgattgtcatatttcctcctcagtcctaaatctcctcttgtcacaggatatcagcattgcttatggggagcacctgatgcaggagcacatgtatgagccagcggggctcatgtttgcccgttgcggtgcccacgagaaagctctct

SEQ ID NO: 5524 - DNA, 170 bp, Homo sapiens
gggagttccaagtataggaactaaggcagctacactggagctttagagaaatgattgtcatatttcctcctcagtcctaaatctcctcttgtcacaggatatcagcattgcttatggggagcacctgatgcaggagcacatgtatgagccagcggggctcatgtttgccc

SEQ ID NO: 5525 - DNA, 170 bp, Homo sapiens
tttcccaggtaattctttcaagggagttccaagtataggaactaaggcagctacactggagctttagagaaatgattgtcatatttcctcctcagtcctaaatctcctcttgtcacaggatatcagcattgcttatggggagcacctgatgcaggagcacatgtatgagc

SEQ ID NO: 5526 - DNA, 170 bp, Homo sapiens
actgtactaactgatcaactgtaagattttcccaggtaattctttcaagggagttccaagtataggaactaaggcagctacactggagctttagagaaatgattgtcatatttcctcctcagtcctaaatctcctcttgtcacaggatatcagcattgcttatggggagc

SEQ ID NO: 5527 - DNA, 170 bp, Homo sapiens
tctgtgtggcagcccagcttaactttaccaaagaccagctggtgggcctcggcagaactctggcaggtaagtacaatcatttatatgtttacatctacaaaggttttaaaaaatttatttcttttgtttggtaattttgcaaataaatttagggcagaatactctgagac

SEQ ID NO: 5528 - DNA, 170 bp, Homo sapiens
acatgtggcaactggaagcaagccctctgtgtggcagcccagcttaactttaccaaagaccagctggtgggcctcggcagaactctggcaggtaagtacaatcatttatatgtttacatctacaaaggttttaaaaaatttatttcttttgtttggtaattttgcaaata

SEQ ID NO: 5529 - DNA, 170 bp, Homo sapiens
cccacgagaaagctctctcagcctttctgacatgtggcaactggaagcaagccctctgtgtggcagcccagcttaactttaccaaagaccagctggtgggcctcggcagaactctggcaggtaagtacaatcatttatatgtttacatctacaaaggttttaaaaaattt

SEQ ID NO: 5530 - DNA, 170 bp, Homo sapiens
ggctcatgtttgcccgttgcggtgcccacgagaaagctctctcagcctttctgacatgtggcaactggaagcaagccctctgtgtggcagcccagcttaactttaccaaagaccagctggtgggcctcggcagaactctggcaggtaagtacaatcatttatatgtttac

SEQ ID NO: 5531 - DNA, 170 bp, Homo sapiens
atgcaggagcacatgtatgagccagcggggctcatgtttgcccgttgcggtgcccacgagaaagctctctcagcctttctgacatgtggcaactggaagcaagccctctgtgtggcagcccagcttaactttaccaaagaccagctggtgggcctcggcagaactctggc

SEQ ID NO: 5532 - DNA, 170 bp, Homo sapiens
gcattgcttatggggagcacctgatgcaggagcacatgtatgagccagcggggctcatgtttgcccgttgcggtgcccacgagaaagctctctcagcctttctgacatgtggcaactggaagcaagccctctgtgtggcagcccagcttaactttaccaaagaccagctg

SEQ ID NO: 5533 - DNA, 170 bp, Homo sapiens
ctaaatctcctcttgtcacaggatatcagcattgcttatggggagcacctgatgcaggagcacatgtatgagccagcggggctcatgtttgcccgttgcggtgcccacgagaaagctctctcagcctttctgacatgtggcaactggaagcaagccctctgtgtggcagc

SEQ ID NO: 5534 - DNA, 170 bp, Homo sapiens
ttgtcatatttcctcctcagtcctaaatctcctcttgtcacaggatatcagcattgcttatggggagcacctgatgcaggagcacatgtatgagccagcggggctcatgtttgcccgttgcggtgcccacgagaaagctctctcagcctttctgacatgtggcaactgga

SEQ ID NO: 5535 - DNA, 170 bp, Homo sapiens
tgcggccatggttttggaagagtgtgcccaggtaaactcaattcctcccttctaaaccccccagtcagcaagaaaggtcttctcaattgtatcttagtgatcatgaaagttaaaggaactgtgcataattgttaagtccagagatagtgtttgccccagaggtcttatct

SEQ ID NO: 5536 - DNA, 170 bp, Homo sapiens
gctggttgagcagaggaagcacattgatgcggccatggttttggaagagtgtgcccaggtaaactcaattcctcccttctaaaccccccagtcagcaagaaaggtcttctcaattgtatcttagtgatcatgaaagttaaaggaactgtgcataattgttaagtccagag

SEQ ID NO: 5537 - DNA, 170 bp, Homo sapiens
gctgcttattgtctctacaggaaagctggttgagcagaggaagcacattgatgcggccatggttttggaagagtgtgcccaggtaaactcaattcctcccttctaaaccccccagtcagcaagaaaggtcttctcaattgtatcttagtgatcatgaaagttaaaggaac

SEQ ID NO: 5538 - DNA, 170 bp, Homo sapiens
aaagtatctgtttaactttgtagtcaactgctgcttattgtctctacaggaaagctggttgagcagaggaagcacattgatgcggccatggttttggaagagtgtgcccaggtaaactcaattcctcccttctaaaccccccagtcagcaagaaaggtcttctcaattgt

SEQ ID NO: 5539 - DNA, 170 bp, Homo sapiens
catattaaagaagcacttgagctaaagtatctgtttaactttgtagtcaactgctgcttattgtctctacaggaaagctggttgagcagaggaagcacattgatgcggccatggttttggaagagtgtgcccaggtaaactcaattcctcccttctaaaccccccagtca

SEQ ID NO: 5540 - DNA, 170 bp, Homo sapiens
agtacatagtttcatacataataaagacatattaaagaagcacttgagctaaagtatctgtttaactttgtagtcaactgctgcttattgtctctacaggaaagctggttgagcagaggaagcacattgatgcggccatggttttggaagagtgtgcccaggtaaactca

SEQ ID NO: 5541 - DNA, 170 bp, Homo sapiens
attccctcacagaaattcagaaagtacatagtttcatacataataaagacatattaaagaagcacttgagctaaagtatctgtttaactttgtagtcaactgctgcttattgtctctacaggaaagctggttgagcagaggaagcacattgatgcggccatggttttgga

SEQ ID NO: 5542 - DNA, 170 bp, Homo sapiens
agataggactctgtggtgtatatacctattccctcacagaaattcagaaagtacatagtttcatacataataaagacatattaaagaagcacttgagctaaagtatctgtttaactttgtagtcaactgctgcttattgtctctacaggaaagctggttgagcagaggaa

SEQ ID NO: 5543 - DNA, 170 bp, Homo sapiens
tgggaagaagctttgaggctggtaagaatcttgtaaatcctctggatgttgggtgctaagcagagagagcaagcaagggattccaggtcagttggaatctcttgtcttctgaggttcatgaaataagtagaaataggtcaggttcctggcttaaggaaaagcggtgtttt

SEQ ID NO: 5544 - DNA, 170 bp, Homo sapiens
gctcttgctgttagaaggagctgcctgggaagaagctttgaggctggtaagaatcttgtaaatcctctggatgttgggtgctaagcagagagagcaagcaagggattccaggtcagttggaatctcttgtcttctgaggttcatgaaataagtagaaataggtcaggttc

SEQ ID NO: 5545 - DNA, 170 bp, Homo sapiens
cccttgtcaggattatgaagaagctgtgctcttgctgttagaaggagctgcctgggaagaagctttgaggctggtaagaatcttgtaaatcctctggatgttgggtgctaagcagagagagcaagcaagggattccaggtcagttggaatctcttgtcttctgaggttca

SEQ ID NO: 5546 - DNA, 170 bp, Homo sapiens
tcacttgttgtcttcttcctgttcccttgtcaggattatgaagaagctgtgctcttgctgttagaaggagctgcctgggaagaagctttgaggctggtaagaatcttgtaaatcctctggatgttgggtgctaagcagagagagcaagcaagggattccaggtcagttgg

SEQ ID NO: 5547 - DNA, 170 bp, Homo sapiens
gctgtgatgacatctgacatgctctcttcacttgttgtcttcttcctgttcccttgtcaggattatgaagaagctgtgctcttgctgttagaaggagctgcctgggaagaagctttgaggctggtaagaatcttgtaaatcctctggatgttgggtgctaagcagagaga

SEQ ID NO: 5548 - DNA, 170 bp, Homo sapiens
gtctgtggttagttttgtagttggctgtgatgacatctgacatgctctcttcacttgttgtcttcttcctgttcccttgtcaggattatgaagaagctgtgctcttgctgttagaaggagctgcctgggaagaagctttgaggctggtaagaatcttgtaaatcctctgg

SEQ ID NO: 5549 - DNA, 170 bp, Homo sapiens
cccctggccagggagatagaggcaggtctgtggttagttttgtagttggctgtgatgacatctgacatgctctcttcacttgttgtcttcttcctgttcccttgtcaggattatgaagaagctgtgctcttgctgttagaaggagctgcctgggaagaagctttgaggct

SEQ ID NO: 5550 - DNA, 170 bp, Homo sapiens
ggcatgatgttgagaactaggagttctcccctggccagggagatagaggcaggtctgtggttagttttgtagttggctgtgatgacatctgacatgctctcttcacttgttgtcttcttcctgttcccttgtcaggattatgaagaagctgtgctcttgctgttagaagg

SEQ ID NO: 5551 - DNA, 170 bp, Homo sapiens
tgaccaagagctggtgcttcttgccacaggtaagcttgttactggtgcctcactggcttttttaaaacattattccagatgtcttacaggcttcatcagctttaggctgcttgaatttcaaaaaatttctttgaaccagtataataccaattatgaaccagtataatacc

SEQ ID NO: 5552 - DNA, 170 bp, Homo sapiens
cagtggtatctctgttatgagttggagtcctgaccaagagctggtgcttcttgccacaggtaagcttgttactggtgcctcactggcttttttaaaacattattccagatgtcttacaggcttcatcagctttaggctgcttgaatttcaaaaaatttctttgaaccagt

SEQ ID NO: 5553 - DNA, 170 bp, Homo sapiens
gctggagtgtgttgggagtgtagccagtggtatctctgttatgagttggagtcctgaccaagagctggtgcttcttgccacaggtaagcttgttactggtgcctcactggcttttttaaaacattattccagatgtcttacaggcttcatcagctttaggctgcttgaat

SEQ ID NO: 5554 - DNA, 170 bp, Homo sapiens
tctcttttcaattttctctgtctcagctggagtgtgttgggagtgtagccagtggtatctctgttatgagttggagtcctgaccaagagctggtgcttcttgccacaggtaagcttgttactggtgcctcactggcttttttaaaacattattccagatgtcttacaggc

SEQ ID NO: 5555 - DNA, 170 bp, Homo sapiens
actgagatgctagtgtttgaatctctcttttcaattttctctgtctcagctggagtgtgttgggagtgtagccagtggtatctctgttatgagttggagtcctgaccaagagctggtgcttcttgccacaggtaagcttgttactggtgcctcactggcttttttaaaac

SEQ ID NO: 5556 - DNA, 170 bp, Homo sapiens
tgttttgattgaagttgcagtcagtttttactgagatgctagtgtttgaatctctcttttcaattttctctgtctcagctggagtgtgttgggagtgtagccagtggtatctctgttatgagttggagtcctgaccaagagctggtgcttcttgccacaggtaagcttgt

SEQ ID NO: 5557 - DNA, 170 bp, Homo sapiens
tgtcttttcgttttgtttttttaattgttttgattgaagttgcagtcagtttttactgagatgctagtgtttgaatctctcttttcaattttctctgtctcagctggagtgtgttgggagtgtagccagtggtatctctgttatgagttggagtcctgaccaagagctgg

SEQ ID NO: 5558 - DNA, 170 bp, Homo sapiens
gcagatatctcttccatatactgatgtcttttcgttttgtttttttaattgttttgattgaagttgcagtcagtttttactgagatgctagtgtttgaatctctcttttcaattttctctgtctcagctggagtgtgttgggagtgtagccagtggtatctctgttatga

SEQ ID NO: 5559 - DNA, 170 bp, Homo sapiens
agaaaccaacgtaaagccttccattttagaaggtgagggttccattttagatagaattcctcatttggaagaaggtgaggagagagagatgagagagtctcctcctatttactgtgttttcttaataatatgtcatgtagactcaatcaaaattaccacctggatataat

SEQ ID NO: 5560 - DNA, 170 bp, Homo sapiens
gtatacaaatataacagactggatattatagaaaccaacgtaaagccttccattttagaaggtgagggttccattttagatagaattcctcatttggaagaaggtgaggagagagagatgagagagtctcctcctatttactgtgttttcttaataatatgtcatgtaga

SEQ ID NO: 5561 - DNA, 170 bp, Homo sapiens
attgtgtttttccttctaggtatacaaatataacagactggatattatagaaaccaacgtaaagccttccattttagaaggtgagggttccattttagatagaattcctcatttggaagaaggtgaggagagagagatgagagagtctcctcctatttactgtgttttct

SEQ ID NO: 5562 - DNA, 170 bp, Homo sapiens
gtgactagaagttttccttcctaaaattattgtgtttttccttctaggtatacaaatataacagactggatattatagaaaccaacgtaaagccttccattttagaaggtgagggttccattttagatagaattcctcatttggaagaaggtgaggagagagagatgaga

SEQ ID NO: 5563 - DNA, 170 bp, Homo sapiens
gtctttctaagtatcttaactctccagtgactagaagttttccttcctaaaattattgtgtttttccttctaggtatacaaatataacagactggatattatagaaaccaacgtaaagccttccattttagaaggtgagggttccattttagatagaattcctcatttgg

SEQ ID NO: 5564 - DNA, 170 bp, Homo sapiens
tgattacctctgaaagtaatccatgtctttctaagtatcttaactctccagtgactagaagttttccttcctaaaattattgtgtttttccttctaggtatacaaatataacagactggatattatagaaaccaacgtaaagccttccattttagaaggtgagggttcca

SEQ ID NO: 5565 - DNA, 170 bp, Homo sapiens
aggcctgtttttcaggaaaatattctgattacctctgaaagtaatccatgtctttctaagtatcttaactctccagtgactagaagttttccttcctaaaattattgtgtttttccttctaggtatacaaatataacagactggatattatagaaaccaacgtaaagcct

SEQ ID NO: 5566 - DNA, 170 bp, Homo sapiens
tgaatttccttggctgccttgtaggaggcctgtttttcaggaaaatattctgattacctctgaaagtaatccatgtctttctaagtatcttaactctccagtgactagaagttttccttcctaaaattattgtgtttttccttctaggtatacaaatataacagactgga

SEQ ID NO: 5567 - DNA, 170 bp, Homo sapiens
caagcccagcaggcaggtctgggtgagtatctgcgtgaaggccatcgacgtgcgggggcagtggggttgggtaacgccacacattgtctagattgcttggtgatccgcctgcaatctgattactgtgccatgggcaagtgtgaggcttctgtggagccccttcagggccc

SEQ ID NO: 5568 - DNA, 170 bp, Homo sapiens
cgtttattggtagttcgagagctcaaggagcaagcccagcaggcaggtctgggtgagtatctgcgtgaaggccatcgacgtgcgggggcagtggggttgggtaacgccacacattgtctagattgcttggtgatccgcctgcaatctgattactgtgccatgggcaagtg

SEQ ID NO: 5569 - DNA, 170 bp, Homo sapiens
ccacattcagtcgccacaagaaacgtttattggtagttcgagagctcaaggagcaagcccagcaggcaggtctgggtgagtatctgcgtgaaggccatcgacgtgcgggggcagtggggttgggtaacgccacacattgtctagattgcttggtgatccgcctgcaatct

SEQ ID NO: 5570 - DNA, 170 bp, Homo sapiens
tggcatttctggactctcagacagccacattcagtcgccacaagaaacgtttattggtagttcgagagctcaaggagcaagcccagcaggcaggtctgggtgagtatctgcgtgaaggccatcgacgtgcgggggcagtggggttgggtaacgccacacattgtctagat

SEQ ID NO: 5571 - DNA, 170 bp, Homo sapiens
ttctgcatctccagcccagaaaaattatatggcatttctggactctcagacagccacattcagtcgccacaagaaacgtttattggtagttcgagagctcaaggagcaagcccagcaggcaggtctgggtgagtatctgcgtgaaggccatcgacgtgcgggggcagtgg

SEQ ID NO: 5572 - DNA, 170 bp, Homo sapiens
tcatgctcaaactattttccattctgcatctccagcccagaaaaattatatggcatttctggactctcagacagccacattcagtcgccacaagaaacgtttattggtagttcgagagctcaaggagcaagcccagcaggcaggtctgggtgagtatctgcgtgaaggcc

SEQ ID NO: 5573 - DNA, 170 bp, Homo sapiens
gcctttagttttttctctttgcttaaacctcatgctcaaactattttccattctgcatctccagcccagaaaaattatatggcatttctggactctcagacagccacattcagtcgccacaagaaacgtttattggtagttcgagagctcaaggagcaagcccagcaggc

SEQ ID NO: 5574 - DNA, 170 bp, Homo sapiens
ccctccttcactgctccccgcctttagttttttctctttgcttaaacctcatgctcaaactattttccattctgcatctccagcccagaaaaattatatggcatttctggactctcagacagccacattcagtcgccacaagaaacgtttattggtagttcgagagctca

SEQ ID NO: 5575 - DNA, 170 bp, Homo sapiens
aacctctttctttttgctgaattttaaccctccttcactgctccccgcctttagttttttctctttgcttaaacctcatgctcaaactattttccattctgcatctccagcccagaaaaattatatggcatttctggactctcagacagccacattcagtcgccacaaga

SEQ ID NO: 5576 - DNA, 170 bp, Homo sapiens
agagctcgcttggaaaacctagtaacctctttctttttgctgaattttaaccctccttcactgctccccgcctttagttttttctctttgcttaaacctcatgctcaaactattttccattctgcatctccagcccagaaaaattatatggcatttctggactctcagac

SEQ ID NO: 5577 - DNA, 170 bp, Homo sapiens
agtaactccaggatatcagcgtacgtatcacattgattcagcacattgactatatcctgggcatatagggaaagtggaagcaaatagattggttttctactgggacggtgtagtgggagtggggagaatattcttcagcgctgtgtggaagttgttcagacactttccca

SEQ ID NO: 5578 - DNA, 170 bp, Homo sapiens
gtgagatgagtggcaaatactcccatagtaactccaggatatcagcgtacgtatcacattgattcagcacattgactatatcctgggcatatagggaaagtggaagcaaatagattggttttctactgggacggtgtagtgggagtggggagaatattcttcagcgctgt

SEQ ID NO: 5579 - DNA, 170 bp, Homo sapiens
tgaaactagcagtgtcgtgagtggcagtgagatgagtggcaaatactcccatagtaactccaggatatcagcgtacgtatcacattgattcagcacattgactatatcctgggcatatagggaaagtggaagcaaatagattggttttctactgggacggtgtagtggga

SEQ ID NO: 5580 - DNA, 170 bp, Homo sapiens
gggcaagagtcagacctcttctctgaaactagcagtgtcgtgagtggcagtgagatgagtggcaaatactcccatagtaactccaggatatcagcgtacgtatcacattgattcagcacattgactatatcctgggcatatagggaaagtggaagcaaatagattggttt

SEQ ID NO: 5581 - DNA, 170 bp, Homo sapiens
ttttctagatgatgaggtaccccacgggcaagagtcagacctcttctctgaaactagcagtgtcgtgagtggcagtgagatgagtggcaaatactcccatagtaactccaggatatcagcgtacgtatcacattgattcagcacattgactatatcctgggcatataggg

SEQ ID NO: 5582 - DNA, 170 bp, Homo sapiens
tgttttcatcggcttctggttcttcttttctagatgatgaggtaccccacgggcaagagtcagacctcttctctgaaactagcagtgtcgtgagtggcagtgagatgagtggcaaatactcccatagtaactccaggatatcagcgtacgtatcacattgattcagcaca

SEQ ID NO: 5583 - DNA, 170 bp, Homo sapiens
gtaaacccacacattagcaggcagtgttttcatcggcttctggttcttcttttctagatgatgaggtaccccacgggcaagagtcagacctcttctctgaaactagcagtgtcgtgagtggcagtgagatgagtggcaaatactcccatagtaactccaggatatcagcg

SEQ ID NO: 5584 - DNA, 170 bp, Homo sapiens
actctagttagttcatttaccgccctgaaagtaaacccacacattagcaggcagtgttttcatcggcttctggttcttcttttctagatgatgaggtaccccacgggcaagagtcagacctcttctctgaaactagcagtgtcgtgagtggcagtgagatgagtggcaaa

SEQ ID NO: 5585 - DNA, 170 bp, Homo sapiens
tcctttgatatgcaccagttgactctagttagttcatttaccgccctgaaagtaaacccacacattagcaggcagtgttttcatcggcttctggttcttcttttctagatgatgaggtaccccacgggcaagagtcagacctcttctctgaaactagcagtgtcgtgagt

SEQ ID NO: 5586 - DNA, 170 bp, Homo sapiens
agatcaactttgcaatcattttcatccatcctttgatatgcaccagttgactctagttagttcatttaccgccctgaaagtaaacccacacattagcaggcagtgttttcatcggcttctggttcttcttttctagatgatgaggtaccccacgggcaagagtcagacct

SEQ ID NO: 5587 - DNA, 170 bp, Homo sapiens
gtgaagtggtgcagaacactgaaaacctgaaaggtatattctcagtcctgatgatgattcctgaccacaaacaatagtgaataggcagtacagacaggcagagttcagtaggtgattaagctaccattttcccaatttgaggaaagatgagaacttttagcaggaagggt

SEQ ID NO: 5588 - DNA, 170 bp, Homo sapiens
tggccctcctggaggcactgagtgaagtggtgcagaacactgaaaacctgaaaggtatattctcagtcctgatgatgattcctgaccacaaacaatagtgaataggcagtacagacaggcagagttcagtaggtgattaagctaccattttcccaatttgaggaaagatg

SEQ ID NO: 5589 - DNA, 170 bp, Homo sapiens
tcaaagaaggcagtccgctggaggacctggccctcctggaggcactgagtgaagtggtgcagaacactgaaaacctgaaaggtatattctcagtcctgatgatgattcctgaccacaaacaatagtgaataggcagtacagacaggcagagttcagtaggtgattaagct

SEQ ID NO: 5590 - DNA, 170 bp, Homo sapiens
agcggagcggaagaagcacagcctcaaagaaggcagtccgctggaggacctggccctcctggaggcactgagtgaagtggtgcagaacactgaaaacctgaaaggtatattctcagtcctgatgatgattcctgaccacaaacaatagtgaataggcagtacagacaggc

SEQ ID NO: 5591 - DNA, 170 bp, Homo sapiens
aacaggagatcatccaagaatcgccgaaaagcggagcggaagaagcacagcctcaaagaaggcagtccgctggaggacctggccctcctggaggcactgagtgaagtggtgcagaacactgaaaacctgaaaggtatattctcagtcctgatgatgattcctgaccacaa

SEQ ID NO: 5592 - DNA, 170 bp, Homo sapiens
ggcttaaaaatatctgtgtaatttctaacaggagatcatccaagaatcgccgaaaagcggagcggaagaagcacagcctcaaagaaggcagtccgctggaggacctggccctcctggaggcactgagtgaagtggtgcagaacactgaaaacctgaaaggtatattctca

SEQ ID NO: 5593 - DNA, 170 bp, Homo sapiens
tgcctgtagtcctagctactcaggaggcttaaaaatatctgtgtaatttctaacaggagatcatccaagaatcgccgaaaagcggagcggaagaagcacagcctcaaagaaggcagtccgctggaggacctggccctcctggaggcactgagtgaagtggtgcagaacac

SEQ ID NO: 5594 - DNA, 170 bp, Homo sapiens
aagaaagtagccaggcaaggtagcacatgcctgtagtcctagctactcaggaggcttaaaaatatctgtgtaatttctaacaggagatcatccaagaatcgccgaaaagcggagcggaagaagcacagcctcaaagaaggcagtccgctggaggacctggccctcctgga

SEQ ID NO: 5595 - DNA, 170 bp, Homo sapiens
tgtgtggggtcatcagcaactgcaagaaagtagccaggcaaggtagcacatgcctgtagtcctagctactcaggaggcttaaaaatatctgtgtaatttctaacaggagatcatccaagaatcgccgaaaagcggagcggaagaagcacagcctcaaagaaggcagtccg

SEQ ID NO: 5596 - DNA, 170 bp, Homo sapiens
aggaatttaaaatggagatctgtgaagttgtgtggggtcatcagcaactgcaagaaagtagccaggcaaggtagcacatgcctgtagtcctagctactcaggaggcttaaaaatatctgtgtaatttctaacaggagatcatccaagaatcgccgaaaagcggagcggaa

SEQ ID NO: 5597 - DNA, 170 bp, Homo sapiens
ccagcagaattcagctaccccggtaagttttctcagagacggtgtgcatttttttcatcattttcatgggttattgtattcacacaatctccaagtcaaaaagttttcctgttcttaaaacataagatgccatagttaaattatcttagatttatgtgtaagctgtcagt

SEQ ID NO: 5598 - DNA, 170 bp, Homo sapiens
tccagaaatttggactcttacttaccagcagaattcagctaccccggtaagttttctcagagacggtgtgcatttttttcatcattttcatgggttattgtattcacacaatctccaagtcaaaaagttttcctgttcttaaaacataagatgccatagttaaattatct

SEQ ID NO: 5599 - DNA, 170 bp, Homo sapiens
ggagaaaggacctgcagtgggatcatagaaatttttggctttggatagaagctatgtatgattctgtcaatggagctgggaatataacttaccactctttcaaatttcttctctctagatgaagtataccatattttaaaggtactctttctctttgagtttgatgaaca

SEQ ID NO: 5600 - DNA, 170 bp, Homo sapiens
ttgggaagaaaaaagataatgtgggagaaaggacctgcagtgggatcatagaaatttttggctttggatagaagctatgtatgattctgtcaatggagctgggaatataacttaccactctttcaaatttcttctctctagatgaagtataccatattttaaaggtactc

SEQ ID NO: 5601 - DNA, 170 bp, Homo sapiens
cgctgcagttgatggaaaggtcacttccagaaatttggactcttacttaccagcagaattcagctaccccggtaagttttctcagagacggtgtgcatttttttcatcattttcatgggttattgtattcacacaatctccaagtcaaaaagttttcctgttcttaaaac

SEQ ID NO: 5602 - DNA, 170 bp, Homo sapiens
agggaattacagaaggcctttgaagatacgctgcagttgatggaaaggtcacttccagaaatttggactcttacttaccagcagaattcagctaccccggtaagttttctcagagacggtgtgcatttttttcatcattttcatgggttattgtattcacacaatctcca

SEQ ID NO: 5603 - DNA, 170 bp, Homo sapiens
tctttgagtttgatgaacaaggaagggaattacagaaggcctttgaagatacgctgcagttgatggaaaggtcacttccagaaatttggactcttacttaccagcagaattcagctaccccggtaagttttctcagagacggtgtgcatttttttcatcattttcatggg

SEQ ID NO: 5604 - DNA, 170 bp, Homo sapiens
gtataccatattttaaaggtactctttctctttgagtttgatgaacaaggaagggaattacagaaggcctttgaagatacgctgcagttgatggaaaggtcacttccagaaatttggactcttacttaccagcagaattcagctaccccggtaagttttctcagagacgg

SEQ ID NO: 5605 - DNA, 170 bp, Homo sapiens
tttcaaatttcttctctctagatgaagtataccatattttaaaggtactctttctctttgagtttgatgaacaaggaagggaattacagaaggcctttgaagatacgctgcagttgatggaaaggtcacttccagaaatttggactcttacttaccagcagaattcagct

SEQ ID NO: 5606 - DNA, 170 bp, Homo sapiens
gctgggaatataacttaccactctttcaaatttcttctctctagatgaagtataccatattttaaaggtactctttctctttgagtttgatgaacaaggaagggaattacagaaggcctttgaagatacgctgcagttgatggaaaggtcacttccagaaatttggactc

SEQ ID NO: 5607 - DNA, 170 bp, Homo sapiens
aagctatgtatgattctgtcaatggagctgggaatataacttaccactctttcaaatttcttctctctagatgaagtataccatattttaaaggtactctttctctttgagtttgatgaacaaggaagggaattacagaaggcctttgaagatacgctgcagttgatgga

SEQ ID NO: 5608 - DNA, 170 bp, Homo sapiens
agaaatttttggctttggatagaagctatgtatgattctgtcaatggagctgggaatataacttaccactctttcaaatttcttctctctagatgaagtataccatattttaaaggtactctttctctttgagtttgatgaacaaggaagggaattacagaaggcctttg

SEQ ID NO: 5609 - DNA, 170 bp, Homo sapiens
caacagaagacttcggttcctgttcttggttagtattttttctcatttaatattacaatactaagcagaaggactatctttctgtaagtattgagaagatcagcagtataaggagagattggatacaatttttcactacaaaaaattgactacaattcttcctcaattct

SEQ ID NO: 5610 - DNA, 170 bp, Homo sapiens
gcaaatagtatcatggcatcttatcagcaacagaagacttcggttcctgttcttggttagtattttttctcatttaatattacaatactaagcagaaggactatctttctgtaagtattgagaagatcagcagtataaggagagattggatacaatttttcactacaaaa

SEQ ID NO: 5611 - DNA, 170 bp, Homo sapiens
tcaggttctaggtcccaattctactgcaaatagtatcatggcatcttatcagcaacagaagacttcggttcctgttcttggttagtattttttctcatttaatattacaatactaagcagaaggactatctttctgtaagtattgagaagatcagcagtataaggagaga

SEQ ID NO: 5612 - DNA, 170 bp, Homo sapiens
tgctgatacagtctattttctcctcaggttctaggtcccaattctactgcaaatagtatcatggcatcttatcagcaacagaagacttcggttcctgttcttggttagtattttttctcatttaatattacaatactaagcagaaggactatctttctgtaagtattgag

SEQ ID NO: 5613 - DNA, 170 bp, Homo sapiens
agtcttgagaagtattagataatctttgctgatacagtctattttctcctcaggttctaggtcccaattctactgcaaatagtatcatggcatcttatcagcaacagaagacttcggttcctgttcttggttagtattttttctcatttaatattacaatactaagcaga

SEQ ID NO: 5614 - DNA, 170 bp, Homo sapiens
gggatttggcctttggtattggcagtcttgagaagtattagataatctttgctgatacagtctattttctcctcaggttctaggtcccaattctactgcaaatagtatcatggcatcttatcagcaacagaagacttcggttcctgttcttggttagtattttttctcat

SEQ ID NO: 5615 - DNA, 170 bp, Homo sapiens
aaatgacaggctgttttctgggggtagggatttggcctttggtattggcagtcttgagaagtattagataatctttgctgatacagtctattttctcctcaggttctaggtcccaattctactgcaaatagtatcatggcatcttatcagcaacagaagacttcggttcc

SEQ ID NO: 5616 - DNA, 170 bp, Homo sapiens
actgtgtttcacaccataccagtagaaatgacaggctgttttctgggggtagggatttggcctttggtattggcagtcttgagaagtattagataatctttgctgatacagtctattttctcctcaggttctaggtcccaattctactgcaaatagtatcatggcatctt

SEQ ID NO: 5617 - DNA, 170 bp, Homo sapiens
agctgagcctgctagactgagtgactgcagttaggagggatccgacagagaagaccatttccactcattcctgttgtcctaccaccccttgctctttgagggctggctattgagaactggaaagagtaaaatgataacttaccttagcattgccaagaacttcagcagac

SEQ ID NO: 5618 - DNA, 170 bp, Homo sapiens
tcaacagaagaacccagtggaagctgagcctgctagactgagtgactgcagttaggagggatccgacagagaagaccatttccactcattcctgttgtcctaccaccccttgctctttgagggctggctattgagaactggaaagagtaaaatgataacttaccttagca

SEQ ID NO: 5619 - DNA, 170 bp, Homo sapiens
agatgctgagctttttataccaccaaagatcaacagaagaacccagtggaagctgagcctgctagactgagtgactgcagttaggagggatccgacagagaagaccatttccactcattcctgttgtcctaccaccccttgctctttgagggctggctattgagaactgg

SEQ ID NO: 5620 - DNA, 170 bp, Homo sapiens
tcacaatttcccttcctttcttgcttttagatgctgagctttttataccaccaaagatcaacagaagaacccagtggaagctgagcctgctagactgagtgactgcagttaggagggatccgacagagaagaccatttccactcattcctgttgtcctaccaccccttgc

SEQ ID NO: 5621 - DNA, 170 bp, Homo sapiens
gccctccaacaagagtatgtctgtcacaatttcccttcctttcttgcttttagatgctgagctttttataccaccaaagatcaacagaagaacccagtggaagctgagcctgctagactgagtgactgcagttaggagggatccgacagagaagaccatttccactcatt

SEQ ID NO: 5622 - DNA, 170 bp, Homo sapiens
tttagtttagagttactgcctcagcgccctccaacaagagtatgtctgtcacaatttcccttcctttcttgcttttagatgctgagctttttataccaccaaagatcaacagaagaacccagtggaagctgagcctgctagactgagtgactgcagttaggagggatccg

SEQ ID NO: 5623 - DNA, 170 bp, Homo sapiens
tgcaaactccacctgcctagtttgtttagtttagagttactgcctcagcgccctccaacaagagtatgtctgtcacaatttcccttcctttcttgcttttagatgctgagctttttataccaccaaagatcaacagaagaacccagtggaagctgagcctgctagactga

SEQ ID NO: 5624 - DNA, 170 bp, Homo sapiens
tctggctctgatggtcttattgctgcaaactccacctgcctagtttgtttagtttagagttactgcctcagcgccctccaacaagagtatgtctgtcacaatttcccttcctttcttgcttttagatgctgagctttttataccaccaaagatcaacagaagaacccagt

SEQ ID NO: 5625 - DNA, 170 bp, Homo sapiens
tcaggatgattttggtgaaagtaagtatagctttgtgcaatattttgtgacctacgtttcttcccatttttgaccatttccttgtgcactaatagccatgtcattaggccaaagaactgtgaaagttaaacccccagctattaaatgtctattagcccagttccttcagc

SEQ ID NO: 5626 - DNA, 170 bp, Homo sapiens
ccaatcctggagcagcagatccatcaggatgattttggtgaaagtaagtatagctttgtgcaatattttgtgacctacgtttcttcccatttttgaccatttccttgtgcactaatagccatgtcattaggccaaagaactgtgaaagttaaacccccagctattaaatg

SEQ ID NO: 5627 - DNA, 170 bp, Homo sapiens
ccctgattatgatgacaaaagattttgagccaatcctggagcagcagatccatcaggatgattttggtgaaagtaagtatagctttgtgcaatattttgtgacctacgtttcttcccatttttgaccatttccttgtgcactaatagccatgtcattaggccaaagaact

SEQ ID NO: 5628 - DNA, 170 bp, Homo sapiens
gtgtttctctaaggtcaacagaccctgattatgatgacaaaagattttgagccaatcctggagcagcagatccatcaggatgattttggtgaaagtaagtatagctttgtgcaatattttgtgacctacgtttcttcccatttttgaccatttccttgtgcactaatagc

SEQ ID NO: 5629 - DNA, 170 bp, Homo sapiens
tgttacatgaaaacaaaatcatttttgtttgtgtttctctaaggtcaacagaccctgattatgatgacaaaagattttgagccaatcctggagcagcagatccatcaggatgattttggtgaaagtaagtatagctttgtgcaatattttgtgacctacgtttcttccca

SEQ ID NO: 5630 - DNA, 170 bp, Homo sapiens
ggtacttaggaatggcaaatttgttacatgaaaacaaaatcatttttgtttgtgtttctctaaggtcaacagaccctgattatgatgacaaaagattttgagccaatcctggagcagcagatccatcaggatgattttggtgaaagtaagtatagctttgtgcaatattt

SEQ ID NO: 5631 - DNA, 170 bp, Homo sapiens
ccagctccttagcttacagtgccataggtacttaggaatggcaaatttgttacatgaaaacaaaatcatttttgtttgtgtttctctaaggtcaacagaccctgattatgatgacaaaagattttgagccaatcctggagcagcagatccatcaggatgattttggtgaa

SEQ ID NO: 5632 - DNA, 170 bp, Homo sapiens
tctgtctgctctgttcagactaactccagctccttagcttacagtgccataggtacttaggaatggcaaatttgttacatgaaaacaaaatcatttttgtttgtgtttctctaaggtcaacagaccctgattatgatgacaaaagattttgagccaatcctggagcagca

SEQ ID NO: 5633 - DNA, 170 bp, Homo sapiens
aagtcaaagcattttggatgaattctgtctgctctgttcagactaactccagctccttagcttacagtgccataggtacttaggaatggcaaatttgttacatgaaaacaaaatcatttttgtttgtgtttctctaaggtcaacagaccctgattatgatgacaaaagat

SEQ ID NO: 5634 - DNA, 170 bp, Homo sapiens
cagacaagcagcttttcagatgcaaatggtaagtttggtttgatggataaaaagccttgactggaacaaatgtaagtttgccacccaccaggaactctttggtgtccacttagatgccagtaatgaacagttctcttctgctttagtaaaactgcctagaaccttcagga

SEQ ID NO: 5635 - DNA, 170 bp, Homo sapiens
acacagttccatggatcagaaggcagacaagcagcttttcagatgcaaatggtaagtttggtttgatggataaaaagccttgactggaacaaatgtaagtttgccacccaccaggaactctttggtgtccacttagatgccagtaatgaacagttctcttctgctttagt

SEQ ID NO: 5636 - DNA, 170 bp, Homo sapiens
tcactgttggatggggtaggaaggagacacagttccatggatcagaaggcagacaagcagcttttcagatgcaaatggtaagtttggtttgatggataaaaagccttgactggaacaaatgtaagtttgccacccaccaggaactctttggtgtccacttagatgccagt

SEQ ID NO: 5637 - DNA, 170 bp, Homo sapiens
tgccaattgttctgtaggcaagtttatcactgttggatggggtaggaaggagacacagttccatggatcagaaggcagacaagcagcttttcagatgcaaatggtaagtttggtttgatggataaaaagccttgactggaacaaatgtaagtttgccacccaccaggaac

SEQ ID NO: 5638 - DNA, 170 bp, Homo sapiens
tcatttcatgtggcttattagttgtcttgccaattgttctgtaggcaagtttatcactgttggatggggtaggaaggagacacagttccatggatcagaaggcagacaagcagcttttcagatgcaaatggtaagtttggtttgatggataaaaagccttgactggaaca

SEQ ID NO: 5639 - DNA, 170 bp, Homo sapiens
agcagtgaaactgtttttgtttcatttcatgtggcttattagttgtcttgccaattgttctgtaggcaagtttatcactgttggatggggtaggaaggagacacagttccatggatcagaaggcagacaagcagcttttcagatgcaaatggtaagtttggtttgatgga

SEQ ID NO: 5640 - DNA, 170 bp, Homo sapiens
ttgccaatgactaacttcatgaagaatagcagtgaaactgtttttgtttcatttcatgtggcttattagttgtcttgccaattgttctgtaggcaagtttatcactgttggatggggtaggaaggagacacagttccatggatcagaaggcagacaagcagcttttcaga

SEQ ID NO: 5641 - DNA, 170 bp, Homo sapiens
gaggcgttagaggacctgagtaattgccaatgactaacttcatgaagaatagcagtgaaactgtttttgtttcatttcatgtggcttattagttgtcttgccaattgttctgtaggcaagtttatcactgttggatggggtaggaaggagacacagttccatggatcaga

SEQ ID NO: 5642 - DNA, 170 bp, Homo sapiens
caaatattgactgctggtcaatttattgagaggcgttagaggacctgagtaattgccaatgactaacttcatgaagaatagcagtgaaactgtttttgtttcatttcatgtggcttattagttgtcttgccaattgttctgtaggcaagtttatcactgttggatggggt

SEQ ID NO: 5643 - DNA, 170 bp, Homo sapiens
tgttgtttgcccagaaacaggtatggaaatatattgcagttaaacaacaataaaaaatttttatcttattaaaattaaggaaaattttctttcttttgctttgagtagggtattaattatacatatgaggcaaggatgtgctgctttaaatgtgaaatgaggttagagtt

SEQ ID NO: 5644 - DNA, 170 bp, Homo sapiens
ggggatggacagttttttgctgtgagtgttgtttgcccagaaacaggtatggaaatatattgcagttaaacaacaataaaaaatttttatcttattaaaattaaggaaaattttctttcttttgctttgagtagggtattaattatacatatgaggcaaggatgtgctgc

SEQ ID NO: 5645 - DNA, 170 bp, Homo sapiens
agaccacaagttacctggcggggggatggacagttttttgctgtgagtgttgtttgcccagaaacaggtatggaaatatattgcagttaaacaacaataaaaaatttttatcttattaaaattaaggaaaattttctttcttttgctttgagtagggtattaattataca

SEQ ID NO: 5646 - DNA, 170 bp, Homo sapiens
tctgctttgccctgggatgaccatagaccacaagttacctggcggggggatggacagttttttgctgtgagtgttgtttgcccagaaacaggtatggaaatatattgcagttaaacaacaataaaaaatttttatcttattaaaattaaggaaaattttctttcttttgc

SEQ ID NO: 5647 - DNA, 170 bp, Homo sapiens
gtaatattggtgtttgttcccctttttagcatgagtctgctttgccctgggatgaccatagaccacaagttacctggcggggggatggacagttttttgctgtgagtgttgtttgcccagaaacaggtatggaaatatattgcagttaaacaacaataaaaaatttttat

SEQ ID NO: 5648 - DNA, 170 bp, Homo sapiens
acttaaggtcccccagtaatattggtgtttgttcccctttttagcatgagtctgctttgccctgggatgaccatagaccacaagttacctggcggggggatggacagttttttgctgtgagtgttgtttgcccagaaacaggtatggaaatatattgcagttaaacaaca

SEQ ID NO: 5649 - DNA, 170 bp, Homo sapiens
tggtctgaggcttgtttgattctgggatacttaaggtcccccagtaatattggtgtttgttcccctttttagcatgagtctgctttgccctgggatgaccatagaccacaagttacctggcggggggatggacagttttttgctgtgagtgttgtttgcccagaaacagg

SEQ ID NO: 5650 - DNA, 170 bp, Homo sapiens
aacctcttaaaaaacatctgtatctagtggtctgaggcttgtttgattctgggatacttaaggtcccccagtaatattggtgtttgttcccctttttagcatgagtctgctttgccctgggatgaccatagaccacaagttacctggcggggggatggacagttttttgc

SEQ ID NO: 5651 - DNA, 170 bp, Homo sapiens
aggcaggctttcaaagtagcttaaacctcttaaaaaacatctgtatctagtggtctgaggcttgtttgattctgggatacttaaggtcccccagtaatattggtgtttgttcccctttttagcatgagtctgctttgccctgggatgaccatagaccacaagttacctgg

SEQ ID NO: 5652 - DNA, 170 bp, Homo sapiens
ggaccagccctggcttggaagtgagtgggagaagaaaccttagagaaattcttggaaccagagtagaggtggtggtacacatggatacagatgatacagatgtttgtgtaacacaaaaggatttttacgtttcttcatttggttataaggctgtatctatctttgtttct

SEQ ID NO: 5653 - DNA, 170 bp, Homo sapiens
accagtgagcctgtggcaggactgggaccagccctggcttggaagtgagtgggagaagaaaccttagagaaattcttggaaccagagtagaggtggtggtacacatggatacagatgatacagatgtttgtgtaacacaaaaggatttttacgtttcttcatttggttat

SEQ ID NO: 5654 - DNA, 170 bp, Homo sapiens
ggaaccgagagtttgctttgcagtcaaccagtgagcctgtggcaggactgggaccagccctggcttggaagtgagtgggagaagaaaccttagagaaattcttggaaccagagtagaggtggtggtacacatggatacagatgatacagatgtttgtgtaacacaaaagg

SEQ ID NO: 5655 - DNA, 170 bp, Homo sapiens
ggggctcggaaggtcagagtgtggaaccgagagtttgctttgcagtcaaccagtgagcctgtggcaggactgggaccagccctggcttggaagtgagtgggagaagaaaccttagagaaattcttggaaccagagtagaggtggtggtacacatggatacagatgataca

SEQ ID NO: 5656 - DNA, 170 bp, Homo sapiens
tgtgtgtttgactccactcccgcacaggggctcggaaggtcagagtgtggaaccgagagtttgctttgcagtcaaccagtgagcctgtggcaggactgggaccagccctggcttggaagtgagtgggagaagaaaccttagagaaattcttggaaccagagtagaggtgg

SEQ ID NO: 5657 - DNA, 170 bp, Homo sapiens
gacaacttttatcataatgttttaagtgtgtatgtgtgtttgactccactcccgcacaggggctcggaaggtcagagtgtggaaccgagagtttgctttgcagtcaaccagtgagcctgtggcaggactgggaccagccctggcttggaagtgagtgggagaagaaacct

SEQ ID NO: 5658 - DNA, 170 bp, Homo sapiens
ggaaggtgtttgaatagttctgaattgacaacttttatcataatgttttaagtgtgtatgtgtgtttgactccactcccgcacaggggctcggaaggtcagagtgtggaaccgagagtttgctttgcagtcaaccagtgagcctgtggcaggactgggaccagccctggc

SEQ ID NO: 5659 - DNA, 170 bp, Homo sapiens
ccatggcagtttttatttgtaaggaaggtgtttgaatagttctgaattgacaacttttatcataatgttttaagtgtgtatgtgtgtttgactccactcccgcacaggggctcggaaggtcagagtgtggaaccgagagtttgctttgcagtcaaccagtgagcctgtgg

SEQ ID NO: 5660 - DNA, 170 bp, Homo sapiens
aattaatctaattggctatgtaaaaccatggcagtttttatttgtaaggaaggtgtttgaatagttctgaattgacaacttttatcataatgttttaagtgtgtatgtgtgtttgactccactcccgcacaggggctcggaaggtcagagtgtggaaccgagagtttgct

SEQ ID NO: 5661 - DNA, 170 bp, Homo sapiens
acactttacacttcccttccttaaagatgaggttaaggtaagtgcctgagtttgtttcaccctcgaatgtagaggactttccatagctatagagggaattttttttttttttttttgagatggagtttcattcttgttgcccaggttggagtgcgatagtgcaatctcgg

SEQ ID NO: 5662 - DNA, 170 bp, Homo sapiens
tgagaaaaatggactccttcatggacactttacacttcccttccttaaagatgaggttaaggtaagtgcctgagtttgtttcaccctcgaatgtagaggactttccatagctatagagggaattttttttttttttttttgagatggagtttcattcttgttgcccaggt

SEQ ID NO: 5663 - DNA, 170 bp, Homo sapiens
accagcaggatattgtgttttttgagaaaaatggactccttcatggacactttacacttcccttccttaaagatgaggttaaggtaagtgcctgagtttgtttcaccctcgaatgtagaggactttccatagctatagagggaattttttttttttttttttgagatgga

SEQ ID NO: 5664 - DNA, 170 bp, Homo sapiens
tgattgcatctacacaagataaacccaaccagcaggatattgtgttttttgagaaaaatggactccttcatggacactttacacttcccttccttaaagatgaggttaaggtaagtgcctgagtttgtttcaccctcgaatgtagaggactttccatagctatagaggga

SEQ ID NO: 5665 - DNA, 170 bp, Homo sapiens
agtttgctttaagaccctcaggcagtttgattgcatctacacaagataaacccaaccagcaggatattgtgttttttgagaaaaatggactccttcatggacactttacacttcccttccttaaagatgaggttaaggtaagtgcctgagtttgtttcaccctcgaatgt

SEQ ID NO: 5666 - DNA, 170 bp, Homo sapiens
agctttcgatattgtaacactctgagtttgctttaagaccctcaggcagtttgattgcatctacacaagataaacccaaccagcaggatattgtgttttttgagaaaaatggactccttcatggacactttacacttcccttccttaaagatgaggttaaggtaagtgcc

SEQ ID NO: 5667 - DNA, 170 bp, Homo sapiens
ggattttatctattctttagttaggtgagctttcgatattgtaacactctgagtttgctttaagaccctcaggcagtttgattgcatctacacaagataaacccaaccagcaggatattgtgttttttgagaaaaatggactccttcatggacactttacacttcccttc

SEQ ID NO: 5668 - DNA, 170 bp, Homo sapiens
tcatgtttgctggaaaaaaaactcttctggattttatctattctttagttaggtgagctttcgatattgtaacactctgagtttgctttaagaccctcaggcagtttgattgcatctacacaagataaacccaaccagcaggatattgtgttttttgagaaaaatggact

SEQ ID NO: 5669 - DNA, 170 bp, Homo sapiens
aattcgttcattcattcattcatgtttgctggaaaaaaaactcttctggattttatctattctttagttaggtgagctttcgatattgtaacactctgagtttgctttaagaccctcaggcagtttgattgcatctacacaagataaacccaaccagcaggatattgtgt

SEQ ID NO: 5670 - DNA, 170 bp, Homo sapiens
aacttccttggataaagatattcattaattcgttcattcattcattcatgtttgctggaaaaaaaactcttctggattttatctattctttagttaggtgagctttcgatattgtaacactctgagtttgctttaagaccctcaggcagtttgattgcatctacacaaga

SEQ ID NO: 5671 - DNA, 170 bp, Homo sapiens
agaccttcagagagaagaaagctccattccgaaaacctgtggtaagacagctgtagtaccccagccttctgccccataaaacgtagttgaaagtagacaggtatgggatttccttcatcccttctacttagtcccttagtagaatcaaagatgctgaagtgggtaggtgg

SEQ ID NO: 5672 - DNA, 170 bp, Homo sapiens
tgcttgcagtctggctggaagaccttcagagagaagaaagctccattccgaaaacctgtggtaagacagctgtagtaccccagccttctgccccataaaacgtagttgaaagtagacaggtatgggatttccttcatcccttctacttagtcccttagtagaatcaaaga

SEQ ID NO: 5673 - DNA, 170 bp, Homo sapiens
tgacttgctctggaatgcagattcctctgtgcttgcagtctggctggaagaccttcagagagaagaaagctccattccgaaaacctgtggtaagacagctgtagtaccccagccttctgccccataaaacgtagttgaaagtagacaggtatgggatttccttcatccct

SEQ ID NO: 5674 - DNA, 170 bp, Homo sapiens
cagatcttttttcccttctaggtaaatgacttgctctggaatgcagattcctctgtgcttgcagtctggctggaagaccttcagagagaagaaagctccattccgaaaacctgtggtaagacagctgtagtaccccagccttctgccccataaaacgtagttgaaagtag

SEQ ID NO: 5675 - DNA, 170 bp, Homo sapiens
aaatccataactgaaagccaatgacagatcttttttcccttctaggtaaatgacttgctctggaatgcagattcctctgtgcttgcagtctggctggaagaccttcagagagaagaaagctccattccgaaaacctgtggtaagacagctgtagtaccccagccttctgc

SEQ ID NO: 5676 - DNA, 170 bp, Homo sapiens
acagctattataaagatttggaagtaaatccataactgaaagccaatgacagatcttttttcccttctaggtaaatgacttgctctggaatgcagattcctctgtgcttgcagtctggctggaagaccttcagagagaagaaagctccattccgaaaacctgtggtaaga

SEQ ID NO: 5677 - DNA, 170 bp, Homo sapiens
tagtgggattatttgatttgagagaggaaatacagctattataaagatttggaagtaaatccataactgaaagccaatgacagatcttttttcccttctaggtaaatgacttgctctggaatgcagattcctctgtgcttgcagtctggctggaagaccttcagagagaa

SEQ ID NO: 5678 - DNA, 170 bp, Homo sapiens
cagctagggatgagctcaggtagtgggattatttgatttgagagaggaaatacagctattataaagatttggaagtaaatccataactgaaagccaatgacagatcttttttcccttctaggtaaatgacttgctctggaatgcagattcctctgtgcttgcagtctggc

SEQ ID NO: 5679 - DNA, 170 bp, Homo sapiens
tgcctctgtaggttagtgatttacagctagggatgagctcaggtagtgggattatttgatttgagagaggaaatacagctattataaagatttggaagtaaatccataactgaaagccaatgacagatcttttttcccttctaggtaaatgacttgctctggaatgcaga

SEQ ID NO: 5680 - DNA, 170 bp, Homo sapiens
gtgaccgaggcacagatcagctgatgccggagggtttgaagccgcgccgcgagggagcgaggtcgcagtgacagcggcgggcgatcggacccaggctgccccgccgtacccgcctgcgtcccgcgctcccgccccagcatgacagccccggcgggtccgcgcggctcagg

SEQ ID NO: 5681 - DNA, 170 bp, Homo sapiens
tgccggagggtttgaagccgcgccgcgagggagcgaggtcgcagtgacagcggcgggcgatcggacccaggctgccccgccgtacccgcctgcgtcccgcgctcccgccccagcatgacagccccggcgggtccgcgcggctcaggtgagggcgcgggcggcaccgtggg

SEQ ID NO: 5682 - DNA, 170 bp, Homo sapiens
gagggagcgaggtcgcagtgacagcggcgggcgatcggacccaggctgccccgccgtacccgcctgcgtcccgcgctcccgccccagcatgacagccccggcgggtccgcgcggctcaggtgagggcgcgggcggcaccgtggggccccgaactcaggcgggcgggctgt

SEQ ID NO: 5683 - DNA, 170 bp, Homo sapiens
gcgatcggacccaggctgccccgccgtacccgcctgcgtcccgcgctcccgccccagcatgacagccccggcgggtccgcgcggctcaggtgagggcgcgggcggcaccgtggggccccgaactcaggcgggcgggctgtgtctcccacctggggcggcggagctcctag

SEQ ID NO: 5684 - DNA, 170 bp, Homo sapiens
ccgcctgcgtcccgcgctcccgccccagcatgacagccccggcgggtccgcgcggctcaggtgagggcgcgggcggcaccgtggggccccgaactcaggcgggcgggctgtgtctcccacctggggcggcggagctcctagtctctttttttctaagctccagcgctgac

SEQ ID NO: 5685 - DNA, 170 bp, Homo sapiens
gccccagcatgacagccccggcgggtccgcgcggctcaggtgagggcgcgggcggcaccgtggggccccgaactcaggcgggcgggctgtgtctcccacctggggcggcggagctcctagtctctttttttctaagctccagcgctgacttttcacggtggagaaaaggg

SEQ ID NO: 5686 - DNA, 170 bp, Homo sapiens
ccaaggtgcgtcctgccaacaccctgggccccaggtcccatccctgctgtcagtgcctatccggggccatatcctcccccaggccccccaaaggaagggctgggccagataggttgacgcagctcccacccgcagaacttggcgagctacgacgtctgcagcatcctcct

SEQ ID NO: 5687 - DNA, 170 bp, Homo sapiens
gggccccaggtcccatccctgctgtcagtgcctatccggggccatatcctcccccaggccccccaaaggaagggctgggccagataggttgacgcagctcccacccgcagaacttggcgagctacgacgtctgcagcatcctcctgggcacctcgacgctgctggtgtgg

SEQ ID NO: 5688 - DNA, 170 bp, Homo sapiens
cagtgcctatccggggccatatcctcccccaggccccccaaaggaagggctgggccagataggttgacgcagctcccacccgcagaacttggcgagctacgacgtctgcagcatcctcctgggcacctcgacgctgctggtgtgggtgggcgtgatccgctacctgacct

SEQ ID NO: 5689 - DNA, 170 bp, Homo sapiens
ccaggccccccaaaggaagggctgggccagataggttgacgcagctcccacccgcagaacttggcgagctacgacgtctgcagcatcctcctgggcacctcgacgctgctggtgtgggtgggcgtgatccgctacctgaccttcttccacaactacaatgtgagttttgc

SEQ ID NO: 5690 - DNA, 170 bp, Homo sapiens
ctgggccagataggttgacgcagctcccacccgcagaacttggcgagctacgacgtctgcagcatcctcctgggcacctcgacgctgctggtgtgggtgggcgtgatccgctacctgaccttcttccacaactacaatgtgagttttgcacatgcagctgggccttccac

SEQ ID NO: 5691 - DNA, 170 bp, Homo sapiens
cccgcagaacttggcgagctacgacgtctgcagcatcctcctgggcacctcgacgctgctggtgtgggtgggcgtgatccgctacctgaccttcttccacaactacaatgtgagttttgcacatgcagctgggccttccacatggttactccacaccctccaaataaatc

SEQ ID NO: 5692 - DNA, 170 bp, Homo sapiens
cgacgtctgcagcatcctcctgggcacctcgacgctgctggtgtgggtgggcgtgatccgctacctgaccttcttccacaactacaatgtgagttttgcacatgcagctgggccttccacatggttactccacaccctccaaataaatccctacacacgcagccctcacc

SEQ ID NO: 5693 - DNA, 170 bp, Homo sapiens
ctcgacgctgctggtgtgggtgggcgtgatccgctacctgaccttcttccacaactacaatgtgagttttgcacatgcagctgggccttccacatggttactccacaccctccaaataaatccctacacacgcagccctcaccagccccggccaatggccccttgcaagc

SEQ ID NO: 5694 - DNA, 170 bp, Homo sapiens
gtgatccgctacctgaccttcttccacaactacaatgtgagttttgcacatgcagctgggccttccacatggttactccacaccctccaaataaatccctacacacgcagccctcaccagccccggccaatggccccttgcaagcctcctcctcctacctgcccacacca

SEQ ID NO: 5695 - DNA, 170 bp, Homo sapiens
cacgccccctctaggcacccactggctcccatgaccacaccggctgtgccctcggcaaggccccgcccctcccacccccatctgggtgcccacagctgacctgagttgtggccacaccctcaacgaggctccctctgccccaacccagatcctcatcgccacactgcggg

SEQ ID NO: 5696 - DNA, 170 bp, Homo sapiens
ctcccatgaccacaccggctgtgccctcggcaaggccccgcccctcccacccccatctgggtgcccacagctgacctgagttgtggccacaccctcaacgaggctccctctgccccaacccagatcctcatcgccacactgcgggtggccctgcccagcgtcatgcgctt

SEQ ID NO: 5697 - DNA, 170 bp, Homo sapiens
gcaaggccccgcccctcccacccccatctgggtgcccacagctgacctgagttgtggccacaccctcaacgaggctccctctgccccaacccagatcctcatcgccacactgcgggtggccctgcccagcgtcatgcgcttctgctgctgcgtggctgtcatctacctgg

SEQ ID NO: 5698 - DNA, 170 bp, Homo sapiens
ccccatctgggtgcccacagctgacctgagttgtggccacaccctcaacgaggctccctctgccccaacccagatcctcatcgccacactgcgggtggccctgcccagcgtcatgcgcttctgctgctgcgtggctgtcatctacctgggctactgcttctgtggctgga

SEQ ID NO: 5699 - DNA, 170 bp, Homo sapiens
tgagttgtggccacaccctcaacgaggctccctctgccccaacccagatcctcatcgccacactgcgggtggccctgcccagcgtcatgcgcttctgctgctgcgtggctgtcatctacctgggctactgcttctgtggctggatcgtgctggggccctatcatgtgaag

SEQ ID NO: 5700 - DNA, 170 bp, Homo sapiens
gctccctctgccccaacccagatcctcatcgccacactgcgggtggccctgcccagcgtcatgcgcttctgctgctgcgtggctgtcatctacctgggctactgcttctgtggctggatcgtgctggggccctatcatgtgaaggtacatctaacccctgatgtccctga

SEQ ID NO: 5701 - DNA, 170 bp, Homo sapiens
tcgccacactgcgggtggccctgcccagcgtcatgcgcttctgctgctgcgtggctgtcatctacctgggctactgcttctgtggctggatcgtgctggggccctatcatgtgaaggtacatctaacccctgatgtccctgacattgaccctgtgaccttgtcattgaca

SEQ ID NO: 5702 - DNA, 170 bp, Homo sapiens
tgcccagcgtcatgcgcttctgctgctgcgtggctgtcatctacctgggctactgcttctgtggctggatcgtgctggggccctatcatgtgaaggtacatctaacccctgatgtccctgacattgaccctgtgaccttgtcattgacactgtgacccccagatgacccc

SEQ ID NO: 5703 - DNA, 170 bp, Homo sapiens
gctgcgtggctgtcatctacctgggctactgcttctgtggctggatcgtgctggggccctatcatgtgaaggtacatctaacccctgatgtccctgacattgaccctgtgaccttgtcattgacactgtgacccccagatgaccccttggtgactgctgggagtctgtcc

SEQ ID NO: 5704 - DNA, 170 bp, Homo sapiens
gctactgcttctgtggctggatcgtgctggggccctatcatgtgaaggtacatctaacccctgatgtccctgacattgaccctgtgaccttgtcattgacactgtgacccccagatgaccccttggtgactgctgggagtctgtccactgtcccctgtggtccttggtga

SEQ ID NO: 5705 - DNA, 170 bp, Homo sapiens
ggacccggccattcatgtggggccccagccaccagctcctagccatttgcatgggaccccagcctgaccccagcccccggttcctggccatgccttggctccctctgaccccgccgcccctctggcagttccgctcactctccatggtgtctgagtgcctgttctcgctc

SEQ ID NO: 5706 - DNA, 170 bp, Homo sapiens
ccagctcctagccatttgcatgggaccccagcctgaccccagcccccggttcctggccatgccttggctccctctgaccccgccgcccctctggcagttccgctcactctccatggtgtctgagtgcctgttctcgctcatcaatggggacgacatgtttgtgacgttcg

SEQ ID NO: 5707 - DNA, 170 bp, Homo sapiens
tcccagctctacctttactccttcatcagcctcttcatctacatggtgctcagcctcttcatcgcgctcatcaccggcgcctacgacaccatcaaggtcagccgcatgcacccagccctgagctcgggctctgggtgccctggagtctgccatgagggggtcttggggac

SEQ ID NO: 5708 - DNA, 170 bp, Homo sapiens
gcctcttcatctacatggtgctcagcctcttcatcgcgctcatcaccggcgcctacgacaccatcaaggtcagccgcatgcacccagccctgagctcgggctctgggtgccctggagtctgccatgagggggtcttggggacaccgcagggtgaacagagaagacccagg

SEQ ID NO: 5709 - DNA, 170 bp, Homo sapiens
tcttcatcgcgctcatcaccggcgcctacgacaccatcaaggtcagccgcatgcacccagccctgagctcgggctctgggtgccctggagtctgccatgagggggtcttggggacaccgcagggtgaacagagaagacccaggagagaatatgggagactctatgaaacc

SEQ ID NO: 5710 - DNA, 170 bp, Homo sapiens
catgggaccccagcctgaccccagcccccggttcctggccatgccttggctccctctgaccccgccgcccctctggcagttccgctcactctccatggtgtctgagtgcctgttctcgctcatcaatggggacgacatgtttgtgacgttcgccgccatgcaggcgcagc

SEQ ID NO: 5711 - DNA, 170 bp, Homo sapiens
ggttcctggccatgccttggctccctctgaccccgccgcccctctggcagttccgctcactctccatggtgtctgagtgcctgttctcgctcatcaatggggacgacatgtttgtgacgttcgccgccatgcaggcgcagcagggccgcagcagcctggtgtggctcttc

SEQ ID NO: 5712 - DNA, 170 bp, Homo sapiens
gaccccgccgcccctctggcagttccgctcactctccatggtgtctgagtgcctgttctcgctcatcaatggggacgacatgtttgtgacgttcgccgccatgcaggcgcagcagggccgcagcagcctggtgtggctcttctcccagctctacctttactccttcatca

SEQ ID NO: 5713 - DNA, 170 bp, Homo sapiens
gttccgctcactctccatggtgtctgagtgcctgttctcgctcatcaatggggacgacatgtttgtgacgttcgccgccatgcaggcgcagcagggccgcagcagcctggtgtggctcttctcccagctctacctttactccttcatcagcctcttcatctacatggtgc

SEQ ID NO: 5714 - DNA, 170 bp, Homo sapiens
tgagtgcctgttctcgctcatcaatggggacgacatgtttgtgacgttcgccgccatgcaggcgcagcagggccgcagcagcctggtgtggctcttctcccagctctacctttactccttcatcagcctcttcatctacatggtgctcagcctcttcatcgcgctcatca

SEQ ID NO: 5715 - DNA, 170 bp, Homo sapiens
tggggacgacatgtttgtgacgttcgccgccatgcaggcgcagcagggccgcagcagcctggtgtggctcttctcccagctctacctttactccttcatcagcctcttcatctacatggtgctcagcctcttcatcgcgctcatcaccggcgcctacgacaccatcaagg

SEQ ID NO: 5716 - DNA, 170 bp, Homo sapiens
cgccatgcaggcgcagcagggccgcagcagcctggtgtggctcttctcccagctctacctttactccttcatcagcctcttcatctacatggtgctcagcctcttcatcgcgctcatcaccggcgcctacgacaccatcaaggtcagccgcatgcacccagccctgagct

SEQ ID NO: 5717 - DNA, 170 bp, Homo sapiens
gcagcagcctggtgtggctcttctcccagctctacctttactccttcatcagcctcttcatctacatggtgctcagcctcttcatcgcgctcatcaccggcgcctacgacaccatcaaggtcagccgcatgcacccagccctgagctcgggctctgggtgccctggagtc

SEQ ID NO: 5718 - DNA, 170 bp, Homo sapiens
actgtggaacaacgggtggagcaggcccagcaagtgcaaaggcccggaggtgggaagcgatgcagatatggctggaggggagggcggacttcaagggccttggaggttgggagccactttcaggctgagcctcccggcttctctccccagcatcccggcggcgcaggcgc

SEQ ID NO: 5719 - DNA, 170 bp, Homo sapiens
cccagcaagtgcaaaggcccggaggtgggaagcgatgcagatatggctggaggggagggcggacttcaagggccttggaggttgggagccactttcaggctgagcctcccggcttctctccccagcatcccggcggcgcaggcgcagaggagagcgagctgcaggcctac

SEQ ID NO: 5720 - DNA, 170 bp, Homo sapiens
ggcctgcagccttctctgctgctgcggaaggttcgagtcccgggtctggcacattcagattggaggttagggaatggggaaaggggagcgagccagagaaaactgacgcccctcttccctgcttccttcctccagggacccctcggaggagcattcgctgctggtgaatt

SEQ ID NO: 5721 - DNA, 170 bp, Homo sapiens
ggtgggaagcgatgcagatatggctggaggggagggcggacttcaagggccttggaggttgggagccactttcaggctgagcctcccggcttctctccccagcatcccggcggcgcaggcgcagaggagagcgagctgcaggcctacatcgcacagtgccaggacagccc

SEQ ID NO: 5722 - DNA, 170 bp, Homo sapiens
ggaggggagggcggacttcaagggccttggaggttgggagccactttcaggctgagcctcccggcttctctccccagcatcccggcggcgcaggcgcagaggagagcgagctgcaggcctacatcgcacagtgccaggacagccccacctccggcaagttccgccgcggg

SEQ ID NO: 5723 - DNA, 170 bp, Homo sapiens
tggaggttgggagccactttcaggctgagcctcccggcttctctccccagcatcccggcggcgcaggcgcagaggagagcgagctgcaggcctacatcgcacagtgccaggacagccccacctccggcaagttccgccgcgggagcggctcggcctgcagccttctctgc

SEQ ID NO: 5724 - DNA, 170 bp, Homo sapiens
tgagcctcccggcttctctccccagcatcccggcggcgcaggcgcagaggagagcgagctgcaggcctacatcgcacagtgccaggacagccccacctccggcaagttccgccgcgggagcggctcggcctgcagccttctctgctgctgcggaaggttcgagtcccggg

SEQ ID NO: 5725 - DNA, 170 bp, Homo sapiens
catcccggcggcgcaggcgcagaggagagcgagctgcaggcctacatcgcacagtgccaggacagccccacctccggcaagttccgccgcgggagcggctcggcctgcagccttctctgctgctgcggaaggttcgagtcccgggtctggcacattcagattggaggtta

SEQ ID NO: 5726 - DNA, 170 bp, Homo sapiens
gagagcgagctgcaggcctacatcgcacagtgccaggacagccccacctccggcaagttccgccgcgggagcggctcggcctgcagccttctctgctgctgcggaaggttcgagtcccgggtctggcacattcagattggaggttagggaatggggaaaggggagcgagc

SEQ ID NO: 5727 - DNA, 170 bp, Homo sapiens
acagtgccaggacagccccacctccggcaagttccgccgcgggagcggctcggcctgcagccttctctgctgctgcggaaggttcgagtcccgggtctggcacattcagattggaggttagggaatggggaaaggggagcgagccagagaaaactgacgcccctcttccc

SEQ ID NO: 5728 - DNA, 170 bp, Homo sapiens
gcaagttccgccgcgggagcggctcggcctgcagccttctctgctgctgcggaaggttcgagtcccgggtctggcacattcagattggaggttagggaatggggaaaggggagcgagccagagaaaactgacgcccctcttccctgcttccttcctccagggacccctcg

SEQ ID NO: 5729 - DNA, 170 bp, Homo sapiens
gagcggctcggcctgcagccttctctgctgctgcggaaggttcgagtcccgggtctggcacattcagattggaggttagggaatggggaaaggggagcgagccagagaaaactgacgcccctcttccctgcttccttcctccagggacccctcggaggagcattcgctgc

SEQ ID NO: 5730 - DNA, 170 bp, Homo sapiens
gctgctgcggaaggttcgagtcccgggtctggcacattcagattggaggttagggaatggggaaaggggagcgagccagagaaaactgacgcccctcttccctgcttccttcctccagggacccctcggaggagcattcgctgctggtgaattgattcgacctgactgcc

SEQ ID NO: 5731 - DNA, 170 bp, Homo sapiens
tcccgggtctggcacattcagattggaggttagggaatggggaaaggggagcgagccagagaaaactgacgcccctcttccctgcttccttcctccagggacccctcggaggagcattcgctgctggtgaattgattcgacctgactgccgttggaccgtaggccctgga

SEQ ID NO: 5732 - DNA, 170 bp, Homo sapiens
ggaatggggaaaggggagcgagccagagaaaactgacgcccctcttccctgcttccttcctccagggacccctcggaggagcattcgctgctggtgaattgattcgacctgactgccgttggaccgtaggccctggactgcagagacccccgcccccgaccccgcttatt

SEQ ID NO: 5733 - DNA, 170 bp, Homo sapiens
agccagagaaaactgacgcccctcttccctgcttccttcctccagggacccctcggaggagcattcgctgctggtgaattgattcgacctgactgccgttggaccgtaggccctggactgcagagacccccgcccccgaccccgcttatttatttgtagggtttgctttt

SEQ ID NO: 5734 - DNA, 170 bp, Homo sapiens
ctcttccctgcttccttcctccagggacccctcggaggagcattcgctgctggtgaattgattcgacctgactgccgttggaccgtaggccctggactgcagagacccccgcccccgaccccgcttatttatttgtagggtttgcttttaaggatcggctccctgtcgcg

SEQ ID NO: 5735 - DNA, 170 bp, Homo sapiens
ccctcggaggagcattcgctgctggtgaattgattcgacctgactgccgttggaccgtaggccctggactgcagagacccccgcccccgaccccgcttatttatttgtagggtttgcttttaaggatcggctccctgtcgcgcccgaggagggcctggacctttcgtgtc

SEQ ID NO: 5736 - DNA, 170 bp, Homo sapiens
gttttctggttttctttagacctctcagagctcttccttggcaggagcatggggacatgaagatagggcgtgtgctgccttcctggttggagaaaggggaaaaggggagttgcccaggcctcaccccagtgccctctcctattcccacagagaccgagcggcttctgacc

SEQ ID NO: 5737 - DNA, 170 bp, Homo sapiens
ctcagagctcttccttggcaggagcatggggacatgaagatagggcgtgtgctgccttcctggttggagaaaggggaaaaggggagttgcccaggcctcaccccagtgccctctcctattcccacagagaccgagcggcttctgacccccaaccccgggtatgggaccca

SEQ ID NO: 5738 - DNA, 170 bp, Homo sapiens
gtcgtctcaaatactttttcatgagtccctgcgacaagtttcgagccaagggccgcaagccctgcaagctgatgctgcaagtggtcaagatcctggtggtcacggtgcaggtgaggccagccaagcaggggccccagctgaaggccacctgtggctgctgtgctccttga

SEQ ID NO: 5739 - DNA, 170 bp, Homo sapiens
gcgacaagtttcgagccaagggccgcaagccctgcaagctgatgctgcaagtggtcaagatcctggtggtcacggtgcaggtgaggccagccaagcaggggccccagctgaaggccacctgtggctgctgtgctccttgaagagagtcttaaagcagcactttggaaggc

SEQ ID NO: 5740 - DNA, 170 bp, Homo sapiens
cgcaagccctgcaagctgatgctgcaagtggtcaagatcctggtggtcacggtgcaggtgaggccagccaagcaggggccccagctgaaggccacctgtggctgctgtgctccttgaagagagtcttaaagcagcactttggaaggccgaggccggtggatcgcttgagg

SEQ ID NO: 5741 - DNA, 170 bp, Homo sapiens
agtggtcaagatcctggtggtcacggtgcaggtgaggccagccaagcaggggccccagctgaaggccacctgtggctgctgtgctccttgaagagagtcttaaagcagcactttggaaggccgaggccggtggatcgcttgaggctgggagttcaagaccagtctggcca

SEQ ID NO: 5742 - DNA, 170 bp, Homo sapiens
atggggacatgaagatagggcgtgtgctgccttcctggttggagaaaggggaaaaggggagttgcccaggcctcaccccagtgccctctcctattcccacagagaccgagcggcttctgacccccaaccccgggtatgggacccaggcggggccttcaccggcccctccg

SEQ ID NO: 5743 - DNA, 170 bp, Homo sapiens
gccttcctggttggagaaaggggaaaaggggagttgcccaggcctcaccccagtgccctctcctattcccacagagaccgagcggcttctgacccccaaccccgggtatgggacccaggcggggccttcaccggcccctccgacacccccagaagaggaagaccttcgcc

SEQ ID NO: 5744 - DNA, 170 bp, Homo sapiens
ggagttgcccaggcctcaccccagtgccctctcctattcccacagagaccgagcggcttctgacccccaaccccgggtatgggacccaggcggggccttcaccggcccctccgacacccccagaagaggaagaccttcgccgtcgtctcaaatactttttcatgagtccc

SEQ ID NO: 5745 - DNA, 170 bp, Homo sapiens
cccagtgccctctcctattcccacagagaccgagcggcttctgacccccaaccccgggtatgggacccaggcggggccttcaccggcccctccgacacccccagaagaggaagaccttcgccgtcgtctcaaatactttttcatgagtccctgcgacaagtttcgagcca

SEQ ID NO: 5746 - DNA, 170 bp, Homo sapiens
accgagcggcttctgacccccaaccccgggtatgggacccaggcggggccttcaccggcccctccgacacccccagaagaggaagaccttcgccgtcgtctcaaatactttttcatgagtccctgcgacaagtttcgagccaagggccgcaagccctgcaagctgatgct

SEQ ID NO: 5747 - DNA, 170 bp, Homo sapiens
ccgggtatgggacccaggcggggccttcaccggcccctccgacacccccagaagaggaagaccttcgccgtcgtctcaaatactttttcatgagtccctgcgacaagtttcgagccaagggccgcaagccctgcaagctgatgctgcaagtggtcaagatcctggtggtc

SEQ ID NO: 5748 - DNA, 170 bp, Homo sapiens
cttcaccggcccctccgacacccccagaagaggaagaccttcgccgtcgtctcaaatactttttcatgagtccctgcgacaagtttcgagccaagggccgcaagccctgcaagctgatgctgcaagtggtcaagatcctggtggtcacggtgcaggtgaggccagccaag

SEQ ID NO: 5749 - DNA, 170 bp, Homo sapiens
cccagaagaggaagaccttcgccgtcgtctcaaatactttttcatgagtccctgcgacaagtttcgagccaagggccgcaagccctgcaagctgatgctgcaagtggtcaagatcctggtggtcacggtgcaggtgaggccagccaagcaggggccccagctgaaggcca

SEQ ID NO: 5750 - DNA, 170 bp, Homo sapiens
gttagcagggccctgccccaccccagtggacatctgcagggccctccctgtcctcttccagggcctgtgccctgagggagatacaccccaacccccatcctagccatgccaacctctactaccctctccccagctcatcctgtttgggctcagtaatcagctggctgtga

SEQ ID NO: 5751 - DNA, 170 bp, Homo sapiens
cccagtggacatctgcagggccctccctgtcctcttccagggcctgtgccctgagggagatacaccccaacccccatcctagccatgccaacctctactaccctctccccagctcatcctgtttgggctcagtaatcagctggctgtgacattccgggaagagaacacca

SEQ ID NO: 5752 - DNA, 170 bp, Homo sapiens
gcagcctacacgcgggagcagctgtaccaggccatcttccatgctgtggaccaggtgctggtgggcgggcaggtgctggtgggcaggcaggtgcaggtgggcgggcaggtgcagttgggcgggcaggtgctggtgggcgggcaggtgcaggtgggtgggctgcagagagc

SEQ ID NO: 5753 - DNA, 170 bp, Homo sapiens
taccaggccatcttccatgctgtggaccaggtgctggtgggcgggcaggtgctggtgggcaggcaggtgcaggtgggcgggcaggtgcagttgggcgggcaggtgctggtgggcgggcaggtgcaggtgggtgggctgcagagagcgggccggactcacaggccctcccc

SEQ ID NO: 5754 - DNA, 170 bp, Homo sapiens
ctgtcctcttccagggcctgtgccctgagggagatacaccccaacccccatcctagccatgccaacctctactaccctctccccagctcatcctgtttgggctcagtaatcagctggctgtgacattccgggaagagaacaccatcgccttccgacacctcttcctgctg

SEQ ID NO: 5755 - DNA, 170 bp, Homo sapiens
cctgagggagatacaccccaacccccatcctagccatgccaacctctactaccctctccccagctcatcctgtttgggctcagtaatcagctggctgtgacattccgggaagagaacaccatcgccttccgacacctcttcctgctgggctactcggacggagcggatga

SEQ ID NO: 5756 - DNA, 170 bp, Homo sapiens
ccatcctagccatgccaacctctactaccctctccccagctcatcctgtttgggctcagtaatcagctggctgtgacattccgggaagagaacaccatcgccttccgacacctcttcctgctgggctactcggacggagcggatgacaccttcgcagcctacacgcggga

SEQ ID NO: 5757 - DNA, 170 bp, Homo sapiens
cctctccccagctcatcctgtttgggctcagtaatcagctggctgtgacattccgggaagagaacaccatcgccttccgacacctcttcctgctgggctactcggacggagcggatgacaccttcgcagcctacacgcgggagcagctgtaccaggccatcttccatgct

SEQ ID NO: 5758 - DNA, 170 bp, Homo sapiens
ttgggctcagtaatcagctggctgtgacattccgggaagagaacaccatcgccttccgacacctcttcctgctgggctactcggacggagcggatgacaccttcgcagcctacacgcgggagcagctgtaccaggccatcttccatgctgtggaccaggtgctggtgggc

SEQ ID NO: 5759 - DNA, 170 bp, Homo sapiens
acattccgggaagagaacaccatcgccttccgacacctcttcctgctgggctactcggacggagcggatgacaccttcgcagcctacacgcgggagcagctgtaccaggccatcttccatgctgtggaccaggtgctggtgggcgggcaggtgctggtgggcaggcaggt

SEQ ID NO: 5760 - DNA, 170 bp, Homo sapiens
cttccgacacctcttcctgctgggctactcggacggagcggatgacaccttcgcagcctacacgcgggagcagctgtaccaggccatcttccatgctgtggaccaggtgctggtgggcgggcaggtgctggtgggcaggcaggtgcaggtgggcgggcaggtgcagttgg

SEQ ID NO: 5761 - DNA, 170 bp, Homo sapiens
ctactcggacggagcggatgacaccttcgcagcctacacgcgggagcagctgtaccaggccatcttccatgctgtggaccaggtgctggtgggcgggcaggtgctggtgggcaggcaggtgcaggtgggcgggcaggtgcagttgggcgggcaggtgctggtgggcgggc

SEQ ID NO: 5762 - DNA, 170 bp, Homo sapiens
aggtgctggtgggcaggcaggtgcaggtgggcgggcaggtgcagttgggcgggcaggtgctggtgggcgggcaggtgcaggtgggtgggctgcagagagcgggccggactcacaggccctccccttctctgcccacagtacctggcgttgcctgacgtgtcactgggccg

SEQ ID NO: 5763 - DNA, 170 bp, Homo sapiens
gtgggcgggcaggtgcagttgggcgggcaggtgctggtgggcgggcaggtgcaggtgggtgggctgcagagagcgggccggactcacaggccctccccttctctgcccacagtacctggcgttgcctgacgtgtcactgggccggtatgcgtatgtccgtggtgggggtg

SEQ ID NO: 5764 - DNA, 170 bp, Homo sapiens
cacgtggacccggccaacgacacatttgacattgatccgatggtggttactggtgagtgggcaggacgaggcttcactgttgggagcctgagctgctgggattaaaatcaacagctgtggctgggcacggtggctcacgcctataataccagcactttgggaggctgagg

SEQ ID NO: 5765 - DNA, 170 bp, Homo sapiens
acatttgacattgatccgatggtggttactggtgagtgggcaggacgaggcttcactgttgggagcctgagctgctgggattaaaatcaacagctgtggctgggcacggtggctcacgcctataataccagcactttgggaggctgaggaggaaggattgcttgaggcca

SEQ ID NO: 5766 - DNA, 170 bp, Homo sapiens
caggtgctggtgggcgggcaggtgcaggtgggtgggctgcagagagcgggccggactcacaggccctccccttctctgcccacagtacctggcgttgcctgacgtgtcactgggccggtatgcgtatgtccgtggtgggggtgacccttggaccaatggctcagggcttg

SEQ ID NO: 5767 - DNA, 170 bp, Homo sapiens
tgggtgggctgcagagagcgggccggactcacaggccctccccttctctgcccacagtacctggcgttgcctgacgtgtcactgggccggtatgcgtatgtccgtggtgggggtgacccttggaccaatggctcagggcttgctctctgccagcggtactaccaccgagg

SEQ ID NO: 5768 - DNA, 170 bp, Homo sapiens
ggccggactcacaggccctccccttctctgcccacagtacctggcgttgcctgacgtgtcactgggccggtatgcgtatgtccgtggtgggggtgacccttggaccaatggctcagggcttgctctctgccagcggtactaccaccgaggccacgtggacccggccaacg

SEQ ID NO: 5769 - DNA, 170 bp, Homo sapiens
tgcccacagtacctggcgttgcctgacgtgtcactgggccggtatgcgtatgtccgtggtgggggtgacccttggaccaatggctcagggcttgctctctgccagcggtactaccaccgaggccacgtggacccggccaacgacacatttgacattgatccgatggtggt

SEQ ID NO: 5770 - DNA, 170 bp, Homo sapiens
ctgacgtgtcactgggccggtatgcgtatgtccgtggtgggggtgacccttggaccaatggctcagggcttgctctctgccagcggtactaccaccgaggccacgtggacccggccaacgacacatttgacattgatccgatggtggttactggtgagtgggcaggacga

SEQ ID NO: 5771 - DNA, 170 bp, Homo sapiens
cgtatgtccgtggtgggggtgacccttggaccaatggctcagggcttgctctctgccagcggtactaccaccgaggccacgtggacccggccaacgacacatttgacattgatccgatggtggttactggtgagtgggcaggacgaggcttcactgttgggagcctgagc

SEQ ID NO: 5772 - DNA, 170 bp, Homo sapiens
gaccaatggctcagggcttgctctctgccagcggtactaccaccgaggccacgtggacccggccaacgacacatttgacattgatccgatggtggttactggtgagtgggcaggacgaggcttcactgttgggagcctgagctgctgggattaaaatcaacagctgtggc

SEQ ID NO: 5773 - DNA, 170 bp, Homo sapiens
gctctctgccagcggtactaccaccgaggccacgtggacccggccaacgacacatttgacattgatccgatggtggttactggtgagtgggcaggacgaggcttcactgttgggagcctgagctgctgggattaaaatcaacagctgtggctgggcacggtggctcacgc

SEQ ID NO: 5774 - DNA, 170 bp, Homo sapiens
gtaaaacatccgcaggcccagagagtgccaggcctgtaggaatgacccaaccctggggaagcacagggaagaaggccactggggactctggggagaccagcctggcctccccggccccctgaggcccttccctgactccctgtccttagactgcatccaggtggatcccc

SEQ ID NO: 5775 - DNA, 170 bp, Homo sapiens
gagagtgccaggcctgtaggaatgacccaaccctggggaagcacagggaagaaggccactggggactctggggagaccagcctggcctccccggccccctgaggcccttccctgactccctgtccttagactgcatccaggtggatccccccgagcggccccctccgccc

SEQ ID NO: 5776 - DNA, 170 bp, Homo sapiens
cctggggaagcacagggaagaaggccactggggactctggggagaccagcctggcctccccggccccctgaggcccttccctgactccctgtccttagactgcatccaggtggatccccccgagcggccccctccgccccccagcgacgatctcaccctcttggaaagca

SEQ ID NO: 5777 - DNA, 170 bp, Homo sapiens
ccactggggactctggggagaccagcctggcctccccggccccctgaggcccttccctgactccctgtccttagactgcatccaggtggatccccccgagcggccccctccgccccccagcgacgatctcaccctcttggaaagcagctccagttacaagaacctcacgc

SEQ ID NO: 5778 - DNA, 170 bp, Homo sapiens
gcctccccggccccctgaggcccttccctgactccctgtccttagactgcatccaggtggatccccccgagcggccccctccgccccccagcgacgatctcaccctcttggaaagcagctccagttacaagaacctcacgctcaaattccacaagtactgcctgctcact

SEQ ID NO: 5779 - DNA, 170 bp, Homo sapiens
ggcccttccctgactccctgtccttagactgcatccaggtggatccccccgagcggccccctccgccccccagcgacgatctcaccctcttggaaagcagctccagttacaagaacctcacgctcaaattccacaagtactgcctgctcactcgaggggggcccagggtg

SEQ ID NO: 5780 - DNA, 170 bp, Homo sapiens
actgcatccaggtggatccccccgagcggccccctccgccccccagcgacgatctcaccctcttggaaagcagctccagttacaagaacctcacgctcaaattccacaagtactgcctgctcactcgaggggggcccagggtgggggaggcagcacactaggcactctca

SEQ ID NO: 5781 - DNA, 170 bp, Homo sapiens
cccctccgccccccagcgacgatctcaccctcttggaaagcagctccagttacaagaacctcacgctcaaattccacaagtactgcctgctcactcgaggggggcccagggtgggggaggcagcacactaggcactctcaccccagcaactacttccctaaggtggggac

SEQ ID NO: 5782 - DNA, 170 bp, Homo sapiens
cgacgatctcaccctcttggaaagcagctccagttacaagaacctcacgctcaaattccacaagtactgcctgctcactcgaggggggcccagggtgggggaggcagcacactaggcactctcaccccagcaactacttccctaaggtggggacagggcccccccgcccg

SEQ ID NO: 5783 - DNA, 170 bp, Homo sapiens
tccagttacaagaacctcacgctcaaattccacaagtactgcctgctcactcgaggggggcccagggtgggggaggcagcacactaggcactctcaccccagcaactacttccctaaggtggggacagggcccccccgcccgcgctggtgcctgctgggtgagcacttcc

SEQ ID NO: 5784 - DNA, 170 bp, Homo sapiens
agggcccccccgcccgcgctggtgcctgctgggtgagcacttcccctgccagctgcagagtcagcacgtggcaggggacgctggcacttggggccggaagggacccgaagacgcccctgaccctcacccgagcctcctgcctaggctggtcaatgtcaccatccacttcc

SEQ ID NO: 5785 - DNA, 170 bp, Homo sapiens
tgcctgctgggtgagcacttcccctgccagctgcagagtcagcacgtggcaggggacgctggcacttggggccggaagggacccgaagacgcccctgaccctcacccgagcctcctgcctaggctggtcaatgtcaccatccacttccggctgaagaccattaacctcca

SEQ ID NO: 5786 - DNA, 170 bp, Homo sapiens
gccagctgcagagtcagcacgtggcaggggacgctggcacttggggccggaagggacccgaagacgcccctgaccctcacccgagcctcctgcctaggctggtcaatgtcaccatccacttccggctgaagaccattaacctccagagcctcatcaataatgagatcccg

SEQ ID NO: 5787 - DNA, 170 bp, Homo sapiens
caggggacgctggcacttggggccggaagggacccgaagacgcccctgaccctcacccgagcctcctgcctaggctggtcaatgtcaccatccacttccggctgaagaccattaacctccagagcctcatcaataatgagatcccggactgctataccttcagcgtcctg

SEQ ID NO: 5788 - DNA, 170 bp, Homo sapiens
ccggaagggacccgaagacgcccctgaccctcacccgagcctcctgcctaggctggtcaatgtcaccatccacttccggctgaagaccattaacctccagagcctcatcaataatgagatcccggactgctataccttcagcgtcctggtgaggccccccgggaacccac

SEQ ID NO: 5789 - DNA, 170 bp, Homo sapiens
ccctcacccgagcctcctgcctaggctggtcaatgtcaccatccacttccggctgaagaccattaacctccagagcctcatcaataatgagatcccggactgctataccttcagcgtcctggtgaggccccccgggaacccacagggctcctgagttccagggcagggac

SEQ ID NO: 5790 - DNA, 170 bp, Homo sapiens
gctggtcaatgtcaccatccacttccggctgaagaccattaacctccagagcctcatcaataatgagatcccggactgctataccttcagcgtcctggtgaggccccccgggaacccacagggctcctgagttccagggcagggacctggtcagggagtgtcttgggagc

SEQ ID NO: 5791 - DNA, 170 bp, Homo sapiens
tccggctgaagaccattaacctccagagcctcatcaataatgagatcccggactgctataccttcagcgtcctggtgaggccccccgggaacccacagggctcctgagttccagggcagggacctggtcagggagtgtcttgggagcactggccaagggcaagcgtgcgg

SEQ ID NO: 5792 - DNA, 170 bp, Homo sapiens
cagagcctcatcaataatgagatcccggactgctataccttcagcgtcctggtgaggccccccgggaacccacagggctcctgagttccagggcagggacctggtcagggagtgtcttgggagcactggccaagggcaagcgtgcgggtgatgagggagggagcccgggg

SEQ ID NO: 5793 - DNA, 170 bp, Homo sapiens
gtcagggagtgtcttgggagcactggccaagggcaagcgtgcgggtgatgagggagggagcccggggtctgtcaggccacctgtcatgtggaccttggggcttggggctgccaaggtttactctgcccccaactggcccccacagatcacgtttgacaacaaagcacaca

SEQ ID NO: 5794 - DNA, 170 bp, Homo sapiens
ccaagggcaagcgtgcgggtgatgagggagggagcccggggtctgtcaggccacctgtcatgtggaccttggggcttggggctgccaaggtttactctgcccccaactggcccccacagatcacgtttgacaacaaagcacacagtgggcggatccccatcagcctggag

SEQ ID NO: 5795 - DNA, 170 bp, Homo sapiens
ggagggagcccggggtctgtcaggccacctgtcatgtggaccttggggcttggggctgccaaggtttactctgcccccaactggcccccacagatcacgtttgacaacaaagcacacagtgggcggatccccatcagcctggagacccaggcccacatccaggagtgtaa

SEQ ID NO: 5796 - DNA, 170 bp, Homo sapiens
ggccacctgtcatgtggaccttggggcttggggctgccaaggtttactctgcccccaactggcccccacagatcacgtttgacaacaaagcacacagtgggcggatccccatcagcctggagacccaggcccacatccaggagtgtaagcaccccagtgtcttccagcac

SEQ ID NO: 5797 - DNA, 170 bp, Homo sapiens
ggcttggggctgccaaggtttactctgcccccaactggcccccacagatcacgtttgacaacaaagcacacagtgggcggatccccatcagcctggagacccaggcccacatccaggagtgtaagcaccccagtgtcttccagcacggtgagcccctgagccccagacca

SEQ ID NO: 5798 - DNA, 170 bp, Homo sapiens
ctgcccccaactggcccccacagatcacgtttgacaacaaagcacacagtgggcggatccccatcagcctggagacccaggcccacatccaggagtgtaagcaccccagtgtcttccagcacggtgagcccctgagccccagaccagcactgaccaggggccctggcctg

SEQ ID NO: 5799 - DNA, 170 bp, Homo sapiens
gtttgacaacaaagcacacagtgggcggatccccatcagcctggagacccaggcccacatccaggagtgtaagcaccccagtgtcttccagcacggtgagcccctgagccccagaccagcactgaccaggggccctggcctgtcctgggattccccaagccccagatcag

SEQ ID NO: 5800 - DNA, 170 bp, Homo sapiens
ggcggatccccatcagcctggagacccaggcccacatccaggagtgtaagcaccccagtgtcttccagcacggtgagcccctgagccccagaccagcactgaccaggggccctggcctgtcctgggattccccaagccccagatcagcgctgcctgggggccgtgacctc

SEQ ID NO: 5801 - DNA, 170 bp, Homo sapiens
aggcccacatccaggagtgtaagcaccccagtgtcttccagcacggtgagcccctgagccccagaccagcactgaccaggggccctggcctgtcctgggattccccaagccccagatcagcgctgcctgggggccgtgacctccccaggaatccgctgagcctcagatca

SEQ ID NO: 5802 - DNA, 170 bp, Homo sapiens
ccaagcaagccctgagcccactgaccaaccaaaaccagccgtgcagccccctaggtctccagcctggcctggcaccaatgctagcctcccaaggctccatgccatccttggccctacccgctctgccctccccgcaggagacaacagcttccggctcctgtttgacgtgg

SEQ ID NO: 5803 - DNA, 170 bp, Homo sapiens
ccaaccaaaaccagccgtgcagccccctaggtctccagcctggcctggcaccaatgctagcctcccaaggctccatgccatccttggccctacccgctctgccctccccgcaggagacaacagcttccggctcctgtttgacgtggtggtcatcctcacctgctccctgt

SEQ ID NO: 5804 - DNA, 170 bp, Homo sapiens
cctaggtctccagcctggcctggcaccaatgctagcctcccaaggctccatgccatccttggccctacccgctctgccctccccgcaggagacaacagcttccggctcctgtttgacgtggtggtcatcctcacctgctccctgtccttcctcctctgcgcccgctcact

SEQ ID NO: 5805 - DNA, 170 bp, Homo sapiens
accaatgctagcctcccaaggctccatgccatccttggccctacccgctctgccctccccgcaggagacaacagcttccggctcctgtttgacgtggtggtcatcctcacctgctccctgtccttcctcctctgcgcccgctcactccttcgaggcttcctgctgcagaa

SEQ ID NO: 5806 - DNA, 170 bp, Homo sapiens
ccatccttggccctacccgctctgccctccccgcaggagacaacagcttccggctcctgtttgacgtggtggtcatcctcacctgctccctgtccttcctcctctgcgcccgctcactccttcgaggcttcctgctgcagaacgtgaggcttctgcgtcatgtgtgctgg

SEQ ID NO: 5807 - DNA, 170 bp, Homo sapiens
ctgccctccccgcaggagacaacagcttccggctcctgtttgacgtggtggtcatcctcacctgctccctgtccttcctcctctgcgcccgctcactccttcgaggcttcctgctgcagaacgtgaggcttctgcgtcatgtgtgctggtgtcctccccgcctggccctg

SEQ ID NO: 5808 - DNA, 170 bp, Homo sapiens
ccggctcctgtttgacgtggtggtcatcctcacctgctccctgtccttcctcctctgcgcccgctcactccttcgaggcttcctgctgcagaacgtgaggcttctgcgtcatgtgtgctggtgtcctccccgcctggccctggggcgataaaagccagggctttgagggt

SEQ ID NO: 5809 - DNA, 170 bp, Homo sapiens
catcctcacctgctccctgtccttcctcctctgcgcccgctcactccttcgaggcttcctgctgcagaacgtgaggcttctgcgtcatgtgtgctggtgtcctccccgcctggccctggggcgataaaagccagggctttgagggtcctgtgcctggtcaggccctcacc

SEQ ID NO: 5810 - DNA, 170 bp, Homo sapiens
tctgcgcccgctcactccttcgaggcttcctgctgcagaacgtgaggcttctgcgtcatgtgtgctggtgtcctccccgcctggccctggggcgataaaagccagggctttgagggtcctgtgcctggtcaggccctcaccccgcctgccttctgcaggagtttgtgggg

SEQ ID NO: 5811 - DNA, 170 bp, Homo sapiens
ggcttcctgctgcagaacgtgaggcttctgcgtcatgtgtgctggtgtcctccccgcctggccctggggcgataaaagccagggctttgagggtcctgtgcctggtcaggccctcaccccgcctgccttctgcaggagtttgtggggttcatgtggcggcagcggggacg

SEQ ID NO: 5812 - DNA, 170 bp, Homo sapiens
tgaggcttctgcgtcatgtgtgctggtgtcctccccgcctggccctggggcgataaaagccagggctttgagggtcctgtgcctggtcaggccctcaccccgcctgccttctgcaggagtttgtggggttcatgtggcggcagcggggacgggtcatcagcctgtgggag

SEQ ID NO: 5813 - DNA, 170 bp, Homo sapiens
tcaccatctcgggcaccatcatgaagatcggcatcgaggccaaggtgcgtcctgccaacaccctgggccccaggtcccatccctgctgtcagtgcctatccggggccatatcctcccccaggccccccaaaggaagggctgggccagataggttgacgcagctcccaccc

SEQ ID NO: 5814 - DNA, 170 bp, Homo sapiens
tccccgcctggccctggggcgataaaagccagggctttgagggtcctgtgcctggtcaggccctcaccccgcctgccttctgcaggagtttgtggggttcatgtggcggcagcggggacgggtcatcagcctgtgggagcggctggaatttgtcaatggctggtacatcc

SEQ ID NO: 5815 - DNA, 170 bp, Homo sapiens
gggcgataaaagccagggctttgagggtcctgtgcctggtcaggccctcaccccgcctgccttctgcaggagtttgtggggttcatgtggcggcagcggggacgggtcatcagcctgtgggagcggctggaatttgtcaatggctggtacatcctgctcgtcaccagcga

SEQ ID NO: 5816 - DNA, 170 bp, Homo sapiens
tgtgcctggtcaggccctcaccccgcctgccttctgcaggagtttgtggggttcatgtggcggcagcggggacgggtcatcagcctgtgggagcggctggaatttgtcaatggctggtacatcctgctcgtcaccagcgatgtgctcaccatctcgggcaccatcatgaa

SEQ ID NO: 5817 - DNA, 170 bp, Homo sapiens
cgcctgccttctgcaggagtttgtggggttcatgtggcggcagcggggacgggtcatcagcctgtgggagcggctggaatttgtcaatggctggtacatcctgctcgtcaccagcgatgtgctcaccatctcgggcaccatcatgaagatcggcatcgaggccaaggtgc

SEQ ID NO: 5818 - DNA, 170 bp, Homo sapiens
gggttcatgtggcggcagcggggacgggtcatcagcctgtgggagcggctggaatttgtcaatggctggtacatcctgctcgtcaccagcgatgtgctcaccatctcgggcaccatcatgaagatcggcatcgaggccaaggtgcgtcctgccaacaccctgggccccag

SEQ ID NO: 5819 - DNA, 170 bp, Homo sapiens
gggtcatcagcctgtgggagcggctggaatttgtcaatggctggtacatcctgctcgtcaccagcgatgtgctcaccatctcgggcaccatcatgaagatcggcatcgaggccaaggtgcgtcctgccaacaccctgggccccaggtcccatccctgctgtcagtgccta

SEQ ID NO: 5820 - DNA, 170 bp, Homo sapiens
tggaatttgtcaatggctggtacatcctgctcgtcaccagcgatgtgctcaccatctcgggcaccatcatgaagatcggcatcgaggccaaggtgcgtcctgccaacaccctgggccccaggtcccatccctgctgtcagtgcctatccggggccatatcctcccccagg

SEQ ID NO: 5821 - DNA, 170 bp, Homo sapiens
cctgctcgtcaccagcgatgtgctcaccatctcgggcaccatcatgaagatcggcatcgaggccaaggtgcgtcctgccaacaccctgggccccaggtcccatccctgctgtcagtgcctatccggggccatatcctcccccaggccccccaaaggaagggctgggccag

SEQ ID NO: 5822 - DNA, 170 bp, Homo sapiens
tgaaatctgcttgggccagtatgatgatggtaaggttgcttttagcttgacctttagagcgagccaggatttttattattacattgaaaatataccacagagatgaataatgctaatttgtagtttatgattgaaaggttagtatctctgtgtaataattaaccttaact

SEQ ID NO: 5823 - DNA, 170 bp, Homo sapiens
gggatcatcctgggctctctctttgaaatctgcttgggccagtatgatgatggtaaggttgcttttagcttgacctttagagcgagccaggatttttattattacattgaaaatataccacagagatgaataatgctaatttgtagtttatgattgaaaggttagtatct

SEQ ID NO: 5824 - DNA, 170 bp, Homo sapiens
acagttttatctctggacatgtttagcttcagggatcatcctgggctctctctttgaaatctgcttgggccagtatgatgatggtaaggttgcttttagcttgacctttagagcgagccaggatttttattattacattgaaaatataccacagagatgaataatgctaa

SEQ ID NO: 5825 - DNA, 170 bp, Homo sapiens
ctttgacagaagatgtttcgacagttttatctctggacatgtttagcttcagggatcatcctgggctctctctttgaaatctgcttgggccagtatgatgatggtaaggttgcttttagcttgacctttagagcgagccaggatttttattattacattgaaaatatacc

SEQ ID NO: 5826 - DNA, 170 bp, Homo sapiens
cttttcttatttcagatcagctttgagtgaactttgacagaagatgtttcgacagttttatctctggacatgtttagcttcagggatcatcctgggctctctctttgaaatctgcttgggccagtatgatgatggtaaggttgcttttagcttgacctttagagcgagcc

SEQ ID NO: 5827 - DNA, 170 bp, Homo sapiens
gaacatgtcaaatgtttctttctaccttttcttatttcagatcagctttgagtgaactttgacagaagatgtttcgacagttttatctctggacatgtttagcttcagggatcatcctgggctctctctttgaaatctgcttgggccagtatgatgatggtaaggttgct

SEQ ID NO: 5828 - DNA, 170 bp, Homo sapiens
tgtgtttacctataacagattaatgaacatgtcaaatgtttctttctaccttttcttatttcagatcagctttgagtgaactttgacagaagatgtttcgacagttttatctctggacatgtttagcttcagggatcatcctgggctctctctttgaaatctgcttgggc

SEQ ID NO: 5829 - DNA, 170 bp, Homo sapiens
aaggcttttctgtgctgtgacaattgtgtttacctataacagattaatgaacatgtcaaatgtttctttctaccttttcttatttcagatcagctttgagtgaactttgacagaagatgtttcgacagttttatctctggacatgtttagcttcagggatcatcctgggc

SEQ ID NO: 5830 - DNA, 170 bp, Homo sapiens
gcacaggtaattaactatgaagtcattaaggcttttctgtgctgtgacaattgtgtttacctataacagattaatgaacatgtcaaatgtttctttctaccttttcttatttcagatcagctttgagtgaactttgacagaagatgtttcgacagttttatctctggaca

SEQ ID NO: 5831 - DNA, 170 bp, Homo sapiens
cctttaagaatagtagctctggacaaggacatagaagatgtaagttaaatacatattttgctcttgtttgtgtaacaaatctcatatttccattaatgggaaatatgacaaagatatggctacataagctagagaagagagaattaagtcactgtaagtgagttttagtg

SEQ ID NO: 5832 - DNA, 170 bp, Homo sapiens
cggacagtctcaatttgacttcacctttaagaatagtagctctggacaaggacatagaagatgtaagttaaatacatattttgctcttgtttgtgtaacaaatctcatatttccattaatgggaaatatgacaaagatatggctacataagctagagaagagagaattaa

SEQ ID NO: 5833 - DNA, 170 bp, Homo sapiens
ttgcatgaaaagtgaaactccaaaaagatagcacgacatatactttctaaatattttcttttcttttcaattttaggctgaacaagacaatggtcatcctcttcctgcctttgccggtctacacattgaaatactggatgaaaacaatcaaagtccatattttacaatgc

SEQ ID NO: 5834 - DNA, 170 bp, Homo sapiens
gatgatattagttaaaaagagaaccctatatattgcatgaaaagtgaaactccaaaaagatagcacgacatatactttctaaatattttcttttcttttcaattttaggctgaacaagacaatggtcatcctcttcctgcctttgccggtctacacattgaaatactgga

SEQ ID NO: 5835 - DNA, 170 bp, Homo sapiens
gccctttaacgtattttttccttatgtgatgatattagttaaaaagagaaccctatatattgcatgaaaagtgaaactccaaaaagatagcacgacatatactttctaaatattttcttttcttttcaattttaggctgaacaagacaatggtcatcctcttcctgcctt

SEQ ID NO: 5836 - DNA, 170 bp, Homo sapiens
gccccagtgggagcaaccatttcggacagtctcaatttgacttcacctttaagaatagtagctctggacaaggacatagaagatgtaagttaaatacatattttgctcttgtttgtgtaacaaatctcatatttccattaatgggaaatatgacaaagatatggctacat

SEQ ID NO: 5837 - DNA, 170 bp, Homo sapiens
gcccagttatcaaggctatatcctggaatctgccccagtgggagcaaccatttcggacagtctcaatttgacttcacctttaagaatagtagctctggacaaggacatagaagatgtaagttaaatacatattttgctcttgtttgtgtaacaaatctcatatttccatt

SEQ ID NO: 5838 - DNA, 170 bp, Homo sapiens
tcaaagtccatattttacaatgcccagttatcaaggctatatcctggaatctgccccagtgggagcaaccatttcggacagtctcaatttgacttcacctttaagaatagtagctctggacaaggacatagaagatgtaagttaaatacatattttgctcttgtttgtgt

SEQ ID NO: 5839 - DNA, 170 bp, Homo sapiens
acacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatgtaagtt

SEQ ID NO: 5840 - DNA, 170 bp, Homo sapiens
tcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggaca

SEQ ID NO: 5841 - DNA, 170 bp, Homo sapiens
ttttaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgac

SEQ ID NO: 5842 - DNA, 170 bp, Homo sapiens
actttctaaatattttcttttcttttcaattttaggctgaacaagacaatggtcatcctcttcctgcctttgccggtctacacattgaaatactggatgaaaacaatcaaagtccatattttacaatgcccagttatcaaggctatatcctggaatctgccccagtggga

SEQ ID NO: 5843 - DNA, 170 bp, Homo sapiens
aaaagatagcacgacatatactttctaaatattttcttttcttttcaattttaggctgaacaagacaatggtcatcctcttcctgcctttgccggtctacacattgaaatactggatgaaaacaatcaaagtccatattttacaatgcccagttatcaaggctatatcct

SEQ ID NO: 5844 - DNA, 170 bp, Homo sapiens
agaacagcaaacttacaccttttcggtaaagagcttttgtgtaaatatacatatgtatgtatgaatgtatgtatgtatgtttgtatggaactgaaagagatgtctggttaaaactgaaaaaatcaatgacttgggggaaaaatacattattttcaataccagagagaaga

SEQ ID NO: 5845 - DNA, 170 bp, Homo sapiens
caccttacttcaaccagtggacagggaagaacagcaaacttacaccttttcggtaaagagcttttgtgtaaatatacatatgtatgtatgaatgtatgtatgtatgtttgtatggaactgaaagagatgtctggttaaaactgaaaaaatcaatgacttgggggaaaaat

SEQ ID NO: 5846 - DNA, 170 bp, Homo sapiens
tctagttaaatatcttttatcgttagaaattcttaatactttcacgtggatttttgctataaatttcaaacattaacttctaggtaatgaactaatagctacattatttattcaacgtttgaaacgatgtcattttttttcaaagacaaaagacccagagcttcaccttt

SEQ ID NO: 5847 - DNA, 170 bp, Homo sapiens
acagactggtattactcgctacctcaccttacttcaaccagtggacagggaagaacagcaaacttacaccttttcggtaaagagcttttgtgtaaatatacatatgtatgtatgaatgtatgtatgtatgtttgtatggaactgaaagagatgtctggttaaaactgaaa

SEQ ID NO: 5848 - DNA, 170 bp, Homo sapiens
acacctcagtcttcaccgtcacacagactggtattactcgctacctcaccttacttcaaccagtggacagggaagaacagcaaacttacaccttttcggtaaagagcttttgtgtaaatatacatatgtatgtatgaatgtatgtatgtatgtttgtatggaactgaaag

SEQ ID NO: 5849 - DNA, 170 bp, Homo sapiens
gagcttcacctttttctgaatgactacacctcagtcttcaccgtcacacagactggtattactcgctacctcaccttacttcaaccagtggacagggaagaacagcaaacttacaccttttcggtaaagagcttttgtgtaaatatacatatgtatgtatgaatgtatgt

SEQ ID NO: 5850 - DNA, 170 bp, Homo sapiens
tgtcattttttttcaaagacaaaagacccagagcttcacctttttctgaatgactacacctcagtcttcaccgtcacacagactggtattactcgctacctcaccttacttcaaccagtggacagggaagaacagcaaacttacaccttttcggtaaagagcttttgtgt

SEQ ID NO: 5851 - DNA, 170 bp, Homo sapiens
atttattcaacgtttgaaacgatgtcattttttttcaaagacaaaagacccagagcttcacctttttctgaatgactacacctcagtcttcaccgtcacacagactggtattactcgctacctcaccttacttcaaccagtggacagggaagaacagcaaacttacacct

SEQ ID NO: 5852 - DNA, 170 bp, Homo sapiens
tctaggtaatgaactaatagctacattatttattcaacgtttgaaacgatgtcattttttttcaaagacaaaagacccagagcttcacctttttctgaatgactacacctcagtcttcaccgtcacacagactggtattactcgctacctcaccttacttcaaccagtgg

SEQ ID NO: 5853 - DNA, 170 bp, Homo sapiens
ttgctataaatttcaaacattaacttctaggtaatgaactaatagctacattatttattcaacgtttgaaacgatgtcattttttttcaaagacaaaagacccagagcttcacctttttctgaatgactacacctcagtcttcaccgtcacacagactggtattactcgc

SEQ ID NO: 5854 - DNA, 170 bp, Homo sapiens
ttcttaatactttcacgtggatttttgctataaatttcaaacattaacttctaggtaatgaactaatagctacattatttattcaacgtttgaaacgatgtcattttttttcaaagacaaaagacccagagcttcacctttttctgaatgactacacctcagtcttcacc

SEQ ID NO: 5855 - DNA, 170 bp, Homo sapiens
ctggggacagtgtcatacaggtaactactcacataatataagtgtacactcaaagctgttatttacatgtgcattatacgatatgctcatgaagaaattacttaagaaacagaaattgatttcacacttattgtatagcataattagtttaaatagctttaaatttctgt

SEQ ID NO: 5856 - DNA, 170 bp, Homo sapiens
tgtgtatgtttatacagacatgagacctggggacagtgtcatacaggtaactactcacataatataagtgtacactcaaagctgttatttacatgtgcattatacgatatgctcatgaagaaattacttaagaaacagaaattgatttcacacttattgtatagcataat

SEQ ID NO: 5857 - DNA, 170 bp, Homo sapiens
atttttgcaccctttcaaattgtaagattacctgtaagaaacttgttaaactgtaagagcaaactctgtactacttatatttgcagaacatctctactaagtgtatttttctcctcccaaagataacagcatttgatggtgtacaagaaagtgagccagtcatcgtcaat

SEQ ID NO: 5858 - DNA, 170 bp, Homo sapiens
ttacgtccttttatcaacaaaatatttttgcaccctttcaaattgtaagattacctgtaagaaacttgttaaactgtaagagcaaactctgtactacttatatttgcagaacatctctactaagtgtatttttctcctcccaaagataacagcatttgatggtgtacaag

SEQ ID NO: 5859 - DNA, 170 bp, Homo sapiens
accttccctgaaatatcctatgatgtgtatgtttatacagacatgagacctggggacagtgtcatacaggtaactactcacataatataagtgtacactcaaagctgttatttacatgtgcattatacgatatgctcatgaagaaattacttaagaaacagaaattgatt

SEQ ID NO: 5860 - DNA, 170 bp, Homo sapiens
tgatggatgcaaatgataacacgccaaccttccctgaaatatcctatgatgtgtatgtttatacagacatgagacctggggacagtgtcatacaggtaactactcacataatataagtgtacactcaaagctgttatttacatgtgcattatacgatatgctcatgaaga

SEQ ID NO: 5861 - DNA, 170 bp, Homo sapiens
gccagtcatcgtcaatattcaagtgatggatgcaaatgataacacgccaaccttccctgaaatatcctatgatgtgtatgtttatacagacatgagacctggggacagtgtcatacaggtaactactcacataatataagtgtacactcaaagctgttatttacatgtgc

SEQ ID NO: 5862 - DNA, 170 bp, Homo sapiens
gataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacaggtaactactcacataatat

SEQ ID NO: 5863 - DNA, 170 bp, Homo sapiens
aagtgtatttttctcctcccaaagataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcat

SEQ ID NO: 5864 - DNA, 170 bp, Homo sapiens
tttgcagaacatctctactaagtgtatttttctcctcccaaagataacagcatttgatggtgtacaagaaagtgagccagtcatcgtcaatattcaagtgatggatgcaaatgataacacgccaaccttccctgaaatatcctatgatgtgtatgtttatacagacatga

SEQ ID NO: 5865 - DNA, 170 bp, Homo sapiens
tgtaagagcaaactctgtactacttatatttgcagaacatctctactaagtgtatttttctcctcccaaagataacagcatttgatggtgtacaagaaagtgagccagtcatcgtcaatattcaagtgatggatgcaaatgataacacgccaaccttccctgaaatatcc

SEQ ID NO: 5866 - DNA, 170 bp, Homo sapiens
acctgtaagaaacttgttaaactgtaagagcaaactctgtactacttatatttgcagaacatctctactaagtgtatttttctcctcccaaagataacagcatttgatggtgtacaagaaagtgagccagtcatcgtcaatattcaagtgatggatgcaaatgataacac

SEQ ID NO: 5867 - DNA, 170 bp, Homo sapiens
agcggataatgctcctcctgcagagcgaaggtaatttatattagaaccaatgcagtcttttcatcgggcccgtttaaccctgtaattaaatttaagaagcgcggcaagtattcttttatcctataaacatctaaattagatcagaaaatcagagagaccagattctcagg

SEQ ID NO: 5868 - DNA, 170 bp, Homo sapiens
acttacgcactcacggtccaagcagcggataatgctcctcctgcagagcgaaggtaatttatattagaaccaatgcagtcttttcatcgggcccgtttaaccctgtaattaaatttaagaagcgcggcaagtattcttttatcctataaacatctaaattagatcagaaa

SEQ ID NO: 5869 - DNA, 170 bp, Homo sapiens
aagcaagcttcttttgttgggggaaaaaacgacatggtggtgaaaagttgagacccaagaggatttatgttgtgattttcaattccagctcactgcagtcgacgcagacgaagggtcaaatggggagatcacatatgaaatccttgttggggctcagggagacttcatca

SEQ ID NO: 5870 - DNA, 170 bp, Homo sapiens
actttcctgtgtttttttctttgaaagcaagcttcttttgttgggggaaaaaacgacatggtggtgaaaagttgagacccaagaggatttatgttgtgattttcaattccagctcactgcagtcgacgcagacgaagggtcaaatggggagatcacatatgaaatccttg

SEQ ID NO: 5871 - DNA, 170 bp, Homo sapiens
aaaacaaaaaacagtatatatgtcaaggaaactttcctgtgtttttttctttgaaagcaagcttcttttgttgggggaaaaaacgacatggtggtgaaaagttgagacccaagaggatttatgttgtgattttcaattccagctcactgcagtcgacgcagacgaagggt

SEQ ID NO: 5872 - DNA, 170 bp, Homo sapiens
ctccaggggtggaaatgatagtcgggcggacttacgcactcacggtccaagcagcggataatgctcctcctgcagagcgaaggtaatttatattagaaccaatgcagtcttttcatcgggcccgtttaaccctgtaattaaatttaagaagcgcggcaagtattctttta

SEQ ID NO: 5873 - DNA, 170 bp, Homo sapiens
acaacagggcttatcaccatcgctccaggggtggaaatgatagtcgggcggacttacgcactcacggtccaagcagcggataatgctcctcctgcagagcgaaggtaatttatattagaaccaatgcagtcttttcatcgggcccgtttaaccctgtaattaaatttaag

SEQ ID NO: 5874 - DNA, 170 bp, Homo sapiens
gctcagggagacttcatcatcaataaaacaacagggcttatcaccatcgctccaggggtggaaatgatagtcgggcggacttacgcactcacggtccaagcagcggataatgctcctcctgcagagcgaaggtaatttatattagaaccaatgcagtcttttcatcgggc

SEQ ID NO: 5875 - DNA, 170 bp, Homo sapiens
ggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggtaatttatat

SEQ ID NO: 5876 - DNA, 170 bp, Homo sapiens
acgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcct

SEQ ID NO: 5877 - DNA, 170 bp, Homo sapiens
ttttcaattccagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacgg

SEQ ID NO: 5878 - DNA, 170 bp, Homo sapiens
tgagacccaagaggatttatgttgtgattttcaattccagctcactgcagtcgacgcagacgaagggtcaaatggggagatcacatatgaaatccttgttggggctcagggagacttcatcatcaataaaacaacagggcttatcaccatcgctccaggggtggaaatga

SEQ ID NO: 5879 - DNA, 170 bp, Homo sapiens
aacgacatggtggtgaaaagttgagacccaagaggatttatgttgtgattttcaattccagctcactgcagtcgacgcagacgaagggtcaaatggggagatcacatatgaaatccttgttggggctcagggagacttcatcatcaataaaacaacagggcttatcacca

SEQ ID NO: 5880 - DNA, 170 bp, Homo sapiens
ggttggtgctgttttattaaatctacaggtatgttccttggtgtgtgtgtgtgtgtgtgtgtataaattctaaagtgacaagcttggcatttaatgagtttatatttgtgtatggagggagaaacctcacatgcttgcctccactctagtgaatgaaaattccatctgga

SEQ ID NO: 5881 - DNA, 170 bp, Homo sapiens
agccttgaaattagtgaagccatgagggttggtgctgttttattaaatctacaggtatgttccttggtgtgtgtgtgtgtgtgtgtgtataaattctaaagtgacaagcttggcatttaatgagtttatatttgtgtatggagggagaaacctcacatgcttgcctccac

SEQ ID NO: 5882 - DNA, 170 bp, Homo sapiens
tttttctatcctttcattttgattgtattatttttcataaaatttggaaattttttctcctgtaaacccaacaactgaataaacaatgcagtctaacattaaatgtgatgcagattcgtaaccatcttcttttcctctctttctctgcaggaactccatctgcactgtgt

SEQ ID NO: 5883 - DNA, 170 bp, Homo sapiens
cgcttcccacagctgatgtatagccttgaaattagtgaagccatgagggttggtgctgttttattaaatctacaggtatgttccttggtgtgtgtgtgtgtgtgtgtgtataaattctaaagtgacaagcttggcatttaatgagtttatatttgtgtatggagggagaa

SEQ ID NO: 5884 - DNA, 170 bp, Homo sapiens
agtgcttccaccaaataatcaaagccctcctcgcttcccacagctgatgtatagccttgaaattagtgaagccatgagggttggtgctgttttattaaatctacaggtatgttccttggtgtgtgtgtgtgtgtgtgtgtataaattctaaagtgacaagcttggcattt

SEQ ID NO: 5885 - DNA, 170 bp, Homo sapiens
ccatctgcactgtgtatattgaagtgcttccaccaaataatcaaagccctcctcgcttcccacagctgatgtatagccttgaaattagtgaagccatgagggttggtgctgttttattaaatctacaggtatgttccttggtgtgtgtgtgtgtgtgtgtgtataaattc

SEQ ID NO: 5886 - DNA, 170 bp, Homo sapiens
tcctctctttctctgcaggaactccatctgcactgtgtatattgaagtgcttccaccaaataatcaaagccctcctcgcttcccacagctgatgtatagccttgaaattagtgaagccatgagggttggtgctgttttattaaatctacaggtatgttccttggtgtgtg

SEQ ID NO: 5887 - DNA, 170 bp, Homo sapiens
tgtgatgcagattcgtaaccatcttcttttcctctctttctctgcaggaactccatctgcactgtgtatattgaagtgcttccaccaaataatcaaagccctcctcgcttcccacagctgatgtatagccttgaaattagtgaagccatgagggttggtgctgttttatt

SEQ ID NO: 5888 - DNA, 170 bp, Homo sapiens
aacaatgcagtctaacattaaatgtgatgcagattcgtaaccatcttcttttcctctctttctctgcaggaactccatctgcactgtgtatattgaagtgcttccaccaaataatcaaagccctcctcgcttcccacagctgatgtatagccttgaaattagtgaagcca

SEQ ID NO: 5889 - DNA, 170 bp, Homo sapiens
ttctcctgtaaacccaacaactgaataaacaatgcagtctaacattaaatgtgatgcagattcgtaaccatcttcttttcctctctttctctgcaggaactccatctgcactgtgtatattgaagtgcttccaccaaataatcaaagccctcctcgcttcccacagctga

SEQ ID NO: 5890 - DNA, 170 bp, Homo sapiens
atttttcataaaatttggaaattttttctcctgtaaacccaacaactgaataaacaatgcagtctaacattaaatgtgatgcagattcgtaaccatcttcttttcctctctttctctgcaggaactccatctgcactgtgtatattgaagtgcttccaccaaataatcaa

SEQ ID NO: 5891 - DNA, 170 bp, Homo sapiens
gaatggagatcctcagagagtttttaatctttcagaaacgtaagttaaaaatgatttcctactttaaaaaaatgtacagcaacgtactgttagtaagaaagcagacttctaatcagaggctttcagctgtttgtagttgtacttccctttctgttttctatgaatgctaa

SEQ ID NO: 5892 - DNA, 170 bp, Homo sapiens
actcaataacatatgccattgagaatggagatcctcagagagtttttaatctttcagaaacgtaagttaaaaatgatttcctactttaaaaaaatgtacagcaacgtactgttagtaagaaagcagacttctaatcagaggctttcagctgtttgtagttgtacttccct

SEQ ID NO: 5893 - DNA, 170 bp, Homo sapiens
aggcaactgatcgagagggagactcaataacatatgccattgagaatggagatcctcagagagtttttaatctttcagaaacgtaagttaaaaatgatttcctactttaaaaaaatgtacagcaacgtactgttagtaagaaagcagacttctaatcagaggctttcagc

SEQ ID NO: 5894 - DNA, 170 bp, Homo sapiens
tgataattgaattatgttttctctctgaaggcaactgatcgagagggagactcaataacatatgccattgagaatggagatcctcagagagtttttaatctttcagaaacgtaagttaaaaatgatttcctactttaaaaaaatgtacagcaacgtactgttagtaagaa

SEQ ID NO: 5895 - DNA, 170 bp, Homo sapiens
tgggcgccatatcaattacttgataattgaattatgttttctctctgaaggcaactgatcgagagggagactcaataacatatgccattgagaatggagatcctcagagagtttttaatctttcagaaacgtaagttaaaaatgatttcctactttaaaaaaatgtacag

SEQ ID NO: 5896 - DNA, 170 bp, Homo sapiens
gtttcaagcttttatattactctgtaatgagtgggcgccatatcaattacttgataattgaattatgttttctctctgaaggcaactgatcgagagggagactcaataacatatgccattgagaatggagatcctcagagagtttttaatctttcagaaacgtaagttaa

SEQ ID NO: 5897 - DNA, 170 bp, Homo sapiens
gtcatggacattctgtgctattagtttcaagcttttatattactctgtaatgagtgggcgccatatcaattacttgataattgaattatgttttctctctgaaggcaactgatcgagagggagactcaataacatatgccattgagaatggagatcctcagagagttttt

SEQ ID NO: 5898 - DNA, 170 bp, Homo sapiens
tgctttaatctttattctttaacagtgtcatggacattctgtgctattagtttcaagcttttatattactctgtaatgagtgggcgccatatcaattacttgataattgaattatgttttctctctgaaggcaactgatcgagagggagactcaataacatatgccattg

SEQ ID NO: 5899 - DNA, 170 bp, Homo sapiens
atcacagcttcagatggcaggccagatggggtgagtatgctccctgtgaaggggttttaaaaatagtattaaggcaactgagagagtcttaaacaatgtatcacagacatgaattaatgtttttcatctggagcaacttcttataattactagaagtgttgctcttttct

SEQ ID NO: 5900 - DNA, 170 bp, Homo sapiens
tgatcgctacattctgatcatcacagcttcagatggcaggccagatggggtgagtatgctccctgtgaaggggttttaaaaatagtattaaggcaactgagagagtcttaaacaatgtatcacagacatgaattaatgtttttcatctggagcaacttcttataattact

SEQ ID NO: 5901 - DNA, 170 bp, Homo sapiens
agcactggacagggaaagcactgatcgctacattctgatcatcacagcttcagatggcaggccagatggggtgagtatgctccctgtgaaggggttttaaaaatagtattaaggcaactgagagagtcttaaacaatgtatcacagacatgaattaatgtttttcatctg

SEQ ID NO: 5902 - DNA, 170 bp, Homo sapiens
agcacggggattctaaccttagggaaagcactggacagggaaagcactgatcgctacattctgatcatcacagcttcagatggcaggccagatggggtgagtatgctccctgtgaaggggttttaaaaatagtattaaggcaactgagagagtcttaaacaatgtatcac

SEQ ID NO: 5903 - DNA, 170 bp, Homo sapiens
gtcttatttgtttgtttgttttgtcactagcacggggattctaaccttagggaaagcactggacagggaaagcactgatcgctacattctgatcatcacagcttcagatggcaggccagatggggtgagtatgctccctgtgaaggggttttaaaaatagtattaaggca

SEQ ID NO: 5904 - DNA, 170 bp, Homo sapiens
tctccttgtgacataatatctctttttgtcttatttgtttgtttgttttgtcactagcacggggattctaaccttagggaaagcactggacagggaaagcactgatcgctacattctgatcatcacagcttcagatggcaggccagatggggtgagtatgctccctgtga

SEQ ID NO: 5905 - DNA, 170 bp, Homo sapiens
aaagtaattcactatactaagaagactctccttgtgacataatatctctttttgtcttatttgtttgtttgttttgtcactagcacggggattctaaccttagggaaagcactggacagggaaagcactgatcgctacattctgatcatcacagcttcagatggcaggcc

SEQ ID NO: 5906 - DNA, 170 bp, Homo sapiens
gagaggggaaaaaaagctatcaaaagtaattcactatactaagaagactctccttgtgacataatatctctttttgtcttatttgtttgtttgttttgtcactagcacggggattctaaccttagggaaagcactggacagggaaagcactgatcgctacattctgatca

SEQ ID NO: 5907 - DNA, 170 bp, Homo sapiens
catctaaaatactcaagctgtgattactgagaggggaaaaaaagctatcaaaagtaattcactatactaagaagactctccttgtgacataatatctctttttgtcttatttgtttgtttgttttgtcactagcacggggattctaaccttagggaaagcactggacagg

SEQ ID NO: 5908 - DNA, 170 bp, Homo sapiens
cctttgtgggtcaagtaaaagtaagtggaatatttatatagatcttatatgtagtttttcaaagagtgtaagtttattacattttaattctcaaaagaaactcagctaatgtaatctgttaaatgactgtgctggatattcttcaagactttaaaaaatgaatcatatcc

SEQ ID NO: 5909 - DNA, 170 bp, Homo sapiens
tctgtggtggaagaagaagccaatgcctttgtgggtcaagtaaaagtaagtggaatatttatatagatcttatatgtagtttttcaaagagtgtaagtttattacattttaattctcaaaagaaactcagctaatgtaatctgttaaatgactgtgctggatattcttca

SEQ ID NO: 5910 - DNA, 170 bp, Homo sapiens
tttatttttattttttggaaagctaaggattagaaagaaaaatgagatgcttttcagatagacaaatgccagaatgactacttaaatgaattctaagtaaaaatagctcctctcacatttaatgcttgtgtttttctttaagacctcaactgccacagtaaacatagtgg

SEQ ID NO: 5911 - DNA, 170 bp, Homo sapiens
tgatccttatctgccaagaaatttatctgtggtggaagaagaagccaatgcctttgtgggtcaagtaaaagtaagtggaatatttatatagatcttatatgtagtttttcaaagagtgtaagtttattacattttaattctcaaaagaaactcagctaatgtaatctgtt

SEQ ID NO: 5912 - DNA, 170 bp, Homo sapiens
tcaatgacaatgctccagtgtttgatccttatctgccaagaaatttatctgtggtggaagaagaagccaatgcctttgtgggtcaagtaaaagtaagtggaatatttatatagatcttatatgtagtttttcaaagagtgtaagtttattacattttaattctcaaaaga

SEQ ID NO: 5913 - DNA, 170 bp, Homo sapiens
aactgccacagtaaacatagtggtgacagatgtcaatgacaatgctccagtgtttgatccttatctgccaagaaatttatctgtggtggaagaagaagccaatgcctttgtgggtcaagtaaaagtaagtggaatatttatatagatcttatatgtagtttttcaaagag

SEQ ID NO: 5914 - DNA, 170 bp, Homo sapiens
tgtgtttttctttaagacctcaactgccacagtaaacatagtggtgacagatgtcaatgacaatgctccagtgtttgatccttatctgccaagaaatttatctgtggtggaagaagaagccaatgcctttgtgggtcaagtaaaagtaagtggaatatttatatagatct

SEQ ID NO: 5915 - DNA, 170 bp, Homo sapiens
aaaatagctcctctcacatttaatgcttgtgtttttctttaagacctcaactgccacagtaaacatagtggtgacagatgtcaatgacaatgctccagtgtttgatccttatctgccaagaaatttatctgtggtggaagaagaagccaatgcctttgtgggtcaagtaa

SEQ ID NO: 5916 - DNA, 170 bp, Homo sapiens
atgactacttaaatgaattctaagtaaaaatagctcctctcacatttaatgcttgtgtttttctttaagacctcaactgccacagtaaacatagtggtgacagatgtcaatgacaatgctccagtgtttgatccttatctgccaagaaatttatctgtggtggaagaaga

SEQ ID NO: 5917 - DNA, 170 bp, Homo sapiens
ttttcagatagacaaatgccagaatgactacttaaatgaattctaagtaaaaatagctcctctcacatttaatgcttgtgtttttctttaagacctcaactgccacagtaaacatagtggtgacagatgtcaatgacaatgctccagtgtttgatccttatctgccaaga

SEQ ID NO: 5918 - DNA, 170 bp, Homo sapiens
aggattagaaagaaaaatgagatgcttttcagatagacaaatgccagaatgactacttaaatgaattctaagtaaaaatagctcctctcacatttaatgcttgtgtttttctttaagacctcaactgccacagtaaacatagtggtgacagatgtcaatgacaatgctcc

SEQ ID NO: 5919 - DNA, 170 bp, Homo sapiens
tgccagctgggactaccatccttcaaatagaggtgtgtgggaaaaagcatttattacatgaatcctacattaggagatttgctattagggtttgtgtgccaaaattagcaagtaacaatacaacataccaagttggattttaatttcagataaacaatgaataaattttt

SEQ ID NO: 5920 - DNA, 170 bp, Homo sapiens
caacatacactgtccttgttgaagagaatttgccagctgggactaccatccttcaaatagaggtgtgtgggaaaaagcatttattacatgaatcctacattaggagatttgctattagggtttgtgtgccaaaattagcaagtaacaatacaacataccaagttggattt

SEQ ID NO: 5921 - DNA, 170 bp, Homo sapiens
ggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactct

SEQ ID NO: 5922 - DNA, 170 bp, Homo sapiens
taataggcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagc

SEQ ID NO: 5923 - DNA, 170 bp, Homo sapiens
tgaatttttttgtttttttgttttatttaataggcaacagaccctgatgctggaataaatggtcaagtgcactacagtttgggtaactttaataatctttttcgtatcacatccaatgggagcatttacacagcagtgaagcttaacagagaagtcagggactactatga

SEQ ID NO: 5924 - DNA, 170 bp, Homo sapiens
cagtagcccgtcaaaacttacgtgaatttttttgtttttttgttttatttaataggcaacagaccctgatgctggaataaatggtcaagtgcactacagtttgggtaactttaataatctttttcgtatcacatccaatgggagcatttacacagcagtgaagcttaaca

SEQ ID NO: 5925 - DNA, 170 bp, Homo sapiens
atttgttaactgttaccttcatttacagtagcccgtcaaaacttacgtgaatttttttgtttttttgttttatttaataggcaacagaccctgatgctggaataaatggtcaagtgcactacagtttgggtaactttaataatctttttcgtatcacatccaatgggagc

SEQ ID NO: 5926 - DNA, 170 bp, Homo sapiens
aatttttggttagaaaaataccataatttgttaactgttaccttcatttacagtagcccgtcaaaacttacgtgaatttttttgtttttttgttttatttaataggcaacagaccctgatgctggaataaatggtcaagtgcactacagtttgggtaactttaataatct

SEQ ID NO: 5927 - DNA, 170 bp, Homo sapiens
tcatttcctccttagagggccaaataatttttggttagaaaaataccataatttgttaactgttaccttcatttacagtagcccgtcaaaacttacgtgaatttttttgtttttttgttttatttaataggcaacagaccctgatgctggaataaatggtcaagtgcact

SEQ ID NO: 5928 - DNA, 170 bp, Homo sapiens
aacagtcctgtgttcaccaattcaacatacactgtccttgttgaagagaatttgccagctgggactaccatccttcaaatagaggtgtgtgggaaaaagcatttattacatgaatcctacattaggagatttgctattagggtttgtgtgccaaaattagcaagtaacaa

SEQ ID NO: 5929 - DNA, 170 bp, Homo sapiens
gccatcaaggttttggacattgatgataacagtcctgtgttcaccaattcaacatacactgtccttgttgaagagaatttgccagctgggactaccatccttcaaatagaggtgtgtgggaaaaagcatttattacatgaatcctacattaggagatttgctattagggt

SEQ ID NO: 5930 - DNA, 170 bp, Homo sapiens
ccctcgtcattcaactctaaccttggccatcaaggttttggacattgatgataacagtcctgtgttcaccaattcaacatacactgtccttgttgaagagaatttgccagctgggactaccatccttcaaatagaggtgtgtgggaaaaagcatttattacatgaatcct

SEQ ID NO: 5931 - DNA, 170 bp, Homo sapiens
tgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggtgtgtggga

SEQ ID NO: 5932 - DNA, 170 bp, Homo sapiens
aagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggact

SEQ ID NO: 5933 - DNA, 170 bp, Homo sapiens
cacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttg

SEQ ID NO: 5934 - DNA, 170 bp, Homo sapiens
gtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcacc

SEQ ID NO: 5935 - DNA, 170 bp, Homo sapiens
agtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttgga

SEQ ID NO: 5936 - DNA, 170 bp, Homo sapiens
gctactgtcacagtgattgtaaaggtaagggctagagatgacttctggttgcctgctttgctctctctacatgtaggttttgttccttctattatacctataatatgttttgataacaattcctaatgacacagtggtaccagacccataacatagattttccaatggaa

SEQ ID NO: 5937 - DNA, 170 bp, Homo sapiens
tggaacaatgccacctggtattgctactgtcacagtgattgtaaaggtaagggctagagatgacttctggttgcctgctttgctctctctacatgtaggttttgttccttctattatacctataatatgttttgataacaattcctaatgacacagtggtaccagaccca

SEQ ID NO: 5938 - DNA, 170 bp, Homo sapiens
ttttggtaacgtcactaataaaactattcttctgcttattacaggccaaagatgtcgaccttggagcaaatgtgtcttaccggataagaagcccagaagtgaagcacttttttgcactacatccatttacaggagaactatcgcttttaaggagtttagattatgaggca

SEQ ID NO: 5939 - DNA, 170 bp, Homo sapiens
acttccatccttcctgcatttctttattttggtaacgtcactaataaaactattcttctgcttattacaggccaaagatgtcgaccttggagcaaatgtgtcttaccggataagaagcccagaagtgaagcacttttttgcactacatccatttacaggagaactatcgc

SEQ ID NO: 5940 - DNA, 170 bp, Homo sapiens
gatgctgtcctaggcactaacgcatgacttccatccttcctgcatttctttattttggtaacgtcactaataaaactattcttctgcttattacaggccaaagatgtcgaccttggagcaaatgtgtcttaccggataagaagcccagaagtgaagcacttttttgcact

SEQ ID NO: 5941 - DNA, 170 bp, Homo sapiens
cgtgtctttttgtcctcgttaaattgatgctgtcctaggcactaacgcatgacttccatccttcctgcatttctttattttggtaacgtcactaataaaactattcttctgcttattacaggccaaagatgtcgaccttggagcaaatgtgtcttaccggataagaagcc

SEQ ID NO: 5942 - DNA, 170 bp, Homo sapiens
gtgcttttttaaaaaacaaaaacaaaaaacgtgtctttttgtcctcgttaaattgatgctgtcctaggcactaacgcatgacttccatccttcctgcatttctttattttggtaacgtcactaataaaactattcttctgcttattacaggccaaagatgtcgaccttgg

SEQ ID NO: 5943 - DNA, 170 bp, Homo sapiens
tctggtagaggcctttgatatttatggaacaatgccacctggtattgctactgtcacagtgattgtaaaggtaagggctagagatgacttctggttgcctgctttgctctctctacatgtaggttttgttccttctattatacctataatatgttttgataacaattcct

SEQ ID NO: 5944 - DNA, 170 bp, Homo sapiens
ccagaccaagaagcaagtatcacttttctggtagaggcctttgatatttatggaacaatgccacctggtattgctactgtcacagtgattgtaaaggtaagggctagagatgacttctggttgcctgctttgctctctctacatgtaggttttgttccttctattatacc

SEQ ID NO: 5945 - DNA, 170 bp, Homo sapiens
cgcttttaaggagtttagattatgaggcatttccagaccaagaagcaagtatcacttttctggtagaggcctttgatatttatggaacaatgccacctggtattgctactgtcacagtgattgtaaaggtaagggctagagatgacttctggttgcctgctttgctctct

SEQ ID NO: 5946 - DNA, 170 bp, Homo sapiens
tccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggtaagggctagagatgacttct

SEQ ID NO: 5947 - DNA, 170 bp, Homo sapiens
gaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgt

SEQ ID NO: 5948 - DNA, 170 bp, Homo sapiens
gtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctgg

SEQ ID NO: 5949 - DNA, 170 bp, Homo sapiens
aaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttga

SEQ ID NO: 5950 - DNA, 170 bp, Homo sapiens
aactattcttctgcttattacaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagt

SEQ ID NO: 5951 - DNA, 170 bp, Homo sapiens
tgatgaagaaagtcggaatggtaagtgagttttttattttacaaatgtcttatctaagagggttttcttcagattttaattctcaatctactatgagtagaggtactaaaatgaaagtttcaacccaaatccatggataattcccctccagtatgggtttaaattatgcc

SEQ ID NO: 5952 - DNA, 170 bp, Homo sapiens
accaccagctaccatagttgctattgatgaagaaagtcggaatggtaagtgagttttttattttacaaatgtcttatctaagagggttttcttcagattttaattctcaatctactatgagtagaggtactaaaatgaaagtttcaacccaaatccatggataattcccc

SEQ ID NO: 5953 - DNA, 170 bp, Homo sapiens
agattgcaaactagctaggggaggaccaccagctaccatagttgctattgatgaagaaagtcggaatggtaagtgagttttttattttacaaatgtcttatctaagagggttttcttcagattttaattctcaatctactatgagtagaggtactaaaatgaaagtttca

SEQ ID NO: 5954 - DNA, 170 bp, Homo sapiens
aattattacttttggttattttctctctttagattgcaaactagctaggggaggaccaccagctaccatagttgctattgatgaagaaagtcggaatggtaagtgagttttttattttacaaatgtcttatctaagagggttttcttcagattttaattctcaatctact

SEQ ID NO: 5955 - DNA, 170 bp, Homo sapiens
tgtgtgtgcccctgcagtcaattattacttttggttattttctctctttagattgcaaactagctaggggaggaccaccagctaccatagttgctattgatgaagaaagtcggaatggtaagtgagttttttattttacaaatgtcttatctaagagggttttcttcaga

SEQ ID NO: 5956 - DNA, 170 bp, Homo sapiens
acatctcaatgaatttttttctcattgtgtgtgcccctgcagtcaattattacttttggttattttctctctttagattgcaaactagctaggggaggaccaccagctaccatagttgctattgatgaagaaagtcggaatggtaagtgagttttttattttacaaatgt

SEQ ID NO: 5957 - DNA, 170 bp, Homo sapiens
tgcaagattttcctttttaaatattaatatacatctcaatgaatttttttctcattgtgtgtgcccctgcagtcaattattacttttggttattttctctctttagattgcaaactagctaggggaggaccaccagctaccatagttgctattgatgaagaaagtcggaa

SEQ ID NO: 5958 - DNA, 170 bp, Homo sapiens
aattgtagtgatgcatattaattagattgcaagattttcctttttaaatattaatatacatctcaatgaatttttttctcattgtgtgtgcccctgcagtcaattattacttttggttattttctctctttagattgcaaactagctaggggaggaccaccagctaccat

SEQ ID NO: 5959 - DNA, 170 bp, Homo sapiens
atgctgaagatgcagaccctcctgtaagtagaaggcattgattaatattctgaactgtactgagaaaaatccttaacactcataaatgaccgaatcacaagacagcaaaagtagtctctgtaaatttcaccctatttattcatacattttatgttcttttacttatttca

SEQ ID NO: 5960 - DNA, 170 bp, Homo sapiens
gtcaagggtacacctatcacaacagtttatgctgaagatgcagaccctcctgtaagtagaaggcattgattaatattctgaactgtactgagaaaaatccttaacactcataaatgaccgaatcacaagacagcaaaagtagtctctgtaaatttcaccctatttattca

SEQ ID NO: 5961 - DNA, 170 bp, Homo sapiens
aagggatggtggctccggatgcagtcaagggtacacctatcacaacagtttatgctgaagatgcagaccctcctgtaagtagaaggcattgattaatattctgaactgtactgagaaaaatccttaacactcataaatgaccgaatcacaagacagcaaaagtagtctct

SEQ ID NO: 5962 - DNA, 170 bp, Homo sapiens
cctcctgtctttagtaaacgaatatacaaagggatggtggctccggatgcagtcaagggtacacctatcacaacagtttatgctgaagatgcagaccctcctgtaagtagaaggcattgattaatattctgaactgtactgagaaaaatccttaacactcataaatgacc

SEQ ID NO: 5963 - DNA, 170 bp, Homo sapiens
gtgttttacaggatatgaatgattatcctcctgtctttagtaaacgaatatacaaagggatggtggctccggatgcagtcaagggtacacctatcacaacagtttatgctgaagatgcagaccctcctgtaagtagaaggcattgattaatattctgaactgtactgaga

SEQ ID NO: 5964 - DNA, 170 bp, Homo sapiens
caactgaagtactaaactcctaattgtgttttacaggatatgaatgattatcctcctgtctttagtaaacgaatatacaaagggatggtggctccggatgcagtcaagggtacacctatcacaacagtttatgctgaagatgcagaccctcctgtaagtagaaggcattg

SEQ ID NO: 5965 - DNA, 170 bp, Homo sapiens
agtaactgtatccctaacctggtttcaactgaagtactaaactcctaattgtgttttacaggatatgaatgattatcctcctgtctttagtaaacgaatatacaaagggatggtggctccggatgcagtcaagggtacacctatcacaacagtttatgctgaagatgcag

SEQ ID NO: 5966 - DNA, 170 bp, Homo sapiens
gtgtgatatgaagactgggagtcaatctagtaactgtatccctaacctggtttcaactgaagtactaaactcctaattgtgttttacaggatatgaatgattatcctcctgtctttagtaaacgaatatacaaagggatggtggctccggatgcagtcaagggtacacct

SEQ ID NO: 5967 - DNA, 170 bp, Homo sapiens
ggctgacagtggtaaataagttgtgtgatatgaagactgggagtcaatctagtaactgtatccctaacctggtttcaactgaagtactaaactcctaattgtgttttacaggatatgaatgattatcctcctgtctttagtaaacgaatatacaaagggatggtggctcc

SEQ ID NO: 5968 - DNA, 170 bp, Homo sapiens
gagtaatggaattgagaggatggaaggctgacagtggtaaataagttgtgtgatatgaagactgggagtcaatctagtaactgtatccctaacctggtttcaactgaagtactaaactcctaattgtgttttacaggatatgaatgattatcctcctgtctttagtaaac

SEQ ID NO: 5969 - DNA, 170 bp, Homo sapiens
aacctacaacaatttttaaggtcagtgtctcttttcattatgtggtctatttgatgtttaatttttgatagagaatttggcttaacagatgacagcacatttttttctttcaatttttctcctttttaatttttttaaattacaatttttttttctcttagaaacttaca

SEQ ID NO: 5970 - DNA, 170 bp, Homo sapiens
acacgagtcaatcttaatgaagaacctacaacaatttttaaggtcagtgtctcttttcattatgtggtctatttgatgtttaatttttgatagagaatttggcttaacagatgacagcacatttttttctttcaatttttctcctttttaatttttttaaattacaattt

SEQ ID NO: 5971 - DNA, 170 bp, Homo sapiens
agaatgaaaatatggaaatatgattttcacttctaaaagaccatgaattttaaagatccatttaatattatcattgcactgtgttttaacttggtaacagcaaattaataattaataattttattttagggattacctgcaagtcgtgtgaggtatagagtagatgatgt

SEQ ID NO: 5972 - DNA, 170 bp, Homo sapiens
tggaagaagattctggaagagtaataacacgagtcaatcttaatgaagaacctacaacaatttttaaggtcagtgtctcttttcattatgtggtctatttgatgtttaatttttgatagagaatttggcttaacagatgacagcacatttttttctttcaatttttctcc

SEQ ID NO: 5973 - DNA, 170 bp, Homo sapiens
tccttaccctgccagtatttttgaagtggaagaagattctggaagagtaataacacgagtcaatcttaatgaagaacctacaacaatttttaaggtcagtgtctcttttcattatgtggtctatttgatgtttaatttttgatagagaatttggcttaacagatgacagc

SEQ ID NO: 5974 - DNA, 170 bp, Homo sapiens
tgaggtatagagtagatgatgtacagtttccttaccctgccagtatttttgaagtggaagaagattctggaagagtaataacacgagtcaatcttaatgaagaacctacaacaatttttaaggtcagtgtctcttttcattatgtggtctatttgatgtttaatttttga

SEQ ID NO: 5975 - DNA, 170 bp, Homo sapiens
agggattacctgcaagtcgtgtgaggtatagagtagatgatgtacagtttccttaccctgccagtatttttgaagtggaagaagattctggaagagtaataacacgagtcaatcttaatgaagaacctacaacaatttttaaggtcagtgtctcttttcattatgtggtc

SEQ ID NO: 5976 - DNA, 170 bp, Homo sapiens
acagcaaattaataattaataattttattttagggattacctgcaagtcgtgtgaggtatagagtagatgatgtacagtttccttaccctgccagtatttttgaagtggaagaagattctggaagagtaataacacgagtcaatcttaatgaagaacctacaacaatttt

SEQ ID NO: 5977 - DNA, 170 bp, Homo sapiens
ttgcactgtgttttaacttggtaacagcaaattaataattaataattttattttagggattacctgcaagtcgtgtgaggtatagagtagatgatgtacagtttccttaccctgccagtatttttgaagtggaagaagattctggaagagtaataacacgagtcaatctt

SEQ ID NO: 5978 - DNA, 170 bp, Homo sapiens
tttaaagatccatttaatattatcattgcactgtgttttaacttggtaacagcaaattaataattaataattttattttagggattacctgcaagtcgtgtgaggtatagagtagatgatgtacagtttccttaccctgccagtatttttgaagtggaagaagattctgg

SEQ ID NO: 5979 - DNA, 170 bp, Homo sapiens
attttcacttctaaaagaccatgaattttaaagatccatttaatattatcattgcactgtgttttaacttggtaacagcaaattaataattaataattttattttagggattacctgcaagtcgtgtgaggtatagagtagatgatgtacagtttccttaccctgccagt

SEQ ID NO: 5980 - DNA, 170 bp, Homo sapiens
gcttcacacaggaggaatataggtattgatttctgtccgattttgaaatacacgaaatgtttagggcatttttgaaaggagtctctcaaaattgatgtaatatgaatttatgagtagacttccaattttggtttaggcgtttctaaattaacataaaatatagtttaaat

SEQ ID NO: 5981 - DNA, 170 bp, Homo sapiens
tgtcttacatcctggtgagatcccacgcttcacacaggaggaatataggtattgatttctgtccgattttgaaatacacgaaatgtttagggcatttttgaaaggagtctctcaaaattgatgtaatatgaatttatgagtagacttccaattttggtttaggcgtttct

SEQ ID NO: 5982 - DNA, 170 bp, Homo sapiens
gcagtgccacagtgaagattcttgtcttacatcctggtgagatcccacgcttcacacaggaggaatataggtattgatttctgtccgattttgaaatacacgaaatgtttagggcatttttgaaaggagtctctcaaaattgatgtaatatgaatttatgagtagacttc

SEQ ID NO: 5983 - DNA, 170 bp, Homo sapiens
ttgatgatggggagcctgtgatgtccagcagtgccacagtgaagattcttgtcttacatcctggtgagatcccacgcttcacacaggaggaatataggtattgatttctgtccgattttgaaatacacgaaatgtttagggcatttttgaaaggagtctctcaaaattga

SEQ ID NO: 5984 - DNA, 170 bp, Homo sapiens
tgctttttaagttggtggtggttgcttttgatgatggggagcctgtgatgtccagcagtgccacagtgaagattcttgtcttacatcctggtgagatcccacgcttcacacaggaggaatataggtattgatttctgtccgattttgaaatacacgaaatgtttagggca

SEQ ID NO: 5985 - DNA, 170 bp, Homo sapiens
acttataatctttaacatgaatttttattgctttttaagttggtggtggttgcttttgatgatggggagcctgtgatgtccagcagtgccacagtgaagattcttgtcttacatcctggtgagatcccacgcttcacacaggaggaatataggtattgatttctgtccga

SEQ ID NO: 5986 - DNA, 170 bp, Homo sapiens
aaattgtgctgttacgctgttcttacttataatctttaacatgaatttttattgctttttaagttggtggtggttgcttttgatgatggggagcctgtgatgtccagcagtgccacagtgaagattcttgtcttacatcctggtgagatcccacgcttcacacaggagga

SEQ ID NO: 5987 - DNA, 170 bp, Homo sapiens
ccaataagtaaaaacatacatataaaaattgtgctgttacgctgttcttacttataatctttaacatgaatttttattgctttttaagttggtggtggttgcttttgatgatggggagcctgtgatgtccagcagtgccacagtgaagattcttgtcttacatcctggtg

SEQ ID NO: 5988 - DNA, 170 bp, Homo sapiens
cttccccttctggaaccaggcaatccaataagtaaaaacatacatataaaaattgtgctgttacgctgttcttacttataatctttaacatgaatttttattgctttttaagttggtggtggttgcttttgatgatggggagcctgtgatgtccagcagtgccacagtga

SEQ ID NO: 5989 - DNA, 170 bp, Homo sapiens
aggcagtgaggaaatgatcattgcttccccttctggaaccaggcaatccaataagtaaaaacatacatataaaaattgtgctgttacgctgttcttacttataatctttaacatgaatttttattgctttttaagttggtggtggttgcttttgatgatggggagcctgt

SEQ ID NO: 5990 - DNA, 170 bp, Homo sapiens
ccattgtttcaggaaatgaagaaggtgagtagacttttagtttgtgttctcaccatcaaccagtaaacttagatttggcctaatttcagattgaattgaaattattatctattctattgttttctaataaaattgtgcccatcttaaatgtaattgttaaccatgtatcc

SEQ ID NO: 5991 - DNA, 170 bp, Homo sapiens
tgccattaatcaaagtattgtgtactccattgtttcaggaaatgaagaaggtgagtagacttttagtttgtgttctcaccatcaaccagtaaacttagatttggcctaatttcagattgaattgaaattattatctattctattgttttctaataaaattgtgcccatct

SEQ ID NO: 5992 - DNA, 170 bp, Homo sapiens
agggaccatggttggtgtaatttctgctgctgccattaatcaaagtattgtgtactccattgtttcaggaaatgaagaaggtgagtagacttttagtttgtgttctcaccatcaaccagtaaacttagatttggcctaatttcagattgaattgaaattattatctattc

SEQ ID NO: 5993 - DNA, 170 bp, Homo sapiens
agtgaacttgccaccaaagggaccatggttggtgtaatttctgctgctgccattaatcaaagtattgtgtactccattgtttcaggaaatgaagaaggtgagtagacttttagtttgtgttctcaccatcaaccagtaaacttagatttggcctaatttcagattgaatt

SEQ ID NO: 5994 - DNA, 170 bp, Homo sapiens
tctctaaacctgcagacctcctccagtaagtgaacttgccaccaaagggaccatggttggtgtaatttctgctgctgccattaatcaaagtattgtgtactccattgtttcaggaaatgaagaaggtgagtagacttttagtttgtgttctcaccatcaaccagtaaact

SEQ ID NO: 5995 - DNA, 170 bp, Homo sapiens
atatttaaaaataaatacatcatcttctctaaacctgcagacctcctccagtaagtgaacttgccaccaaagggaccatggttggtgtaatttctgctgctgccattaatcaaagtattgtgtactccattgtttcaggaaatgaagaaggtgagtagacttttagtttg

SEQ ID NO: 5996 - DNA, 170 bp, Homo sapiens
tgaacgtaaagttacatcaaaaattatatttaaaaataaatacatcatcttctctaaacctgcagacctcctccagtaagtgaacttgccaccaaagggaccatggttggtgtaatttctgctgctgccattaatcaaagtattgtgtactccattgtttcaggaaatga

SEQ ID NO: 5997 - DNA, 170 bp, Homo sapiens
tcttatctttctctcaatttttctgtgaacgtaaagttacatcaaaaattatatttaaaaataaatacatcatcttctctaaacctgcagacctcctccagtaagtgaacttgccaccaaagggaccatggttggtgtaatttctgctgctgccattaatcaaagtattg

SEQ ID NO: 5998 - DNA, 170 bp, Homo sapiens
gggcagagggtatatcagaaatctcttatctttctctcaatttttctgtgaacgtaaagttacatcaaaaattatatttaaaaataaatacatcatcttctctaaacctgcagacctcctccagtaagtgaacttgccaccaaagggaccatggttggtgtaatttctgc

SEQ ID NO: 5999 - DNA, 170 bp, Homo sapiens
tggaggaggccatgaatgtgtgagggcagagggtatatcagaaatctcttatctttctctcaatttttctgtgaacgtaaagttacatcaaaaattatatttaaaaataaatacatcatcttctctaaacctgcagacctcctccagtaagtgaacttgccaccaaaggg

SEQ ID NO: 6000 - DNA, 170 bp, Homo sapiens
tctccgagttccttcaaaaagtaagttatactacttaaagcttttaccagaattgtatggtgtctctgctaattttttaaatgaaatacctatgtctaaaatatcattctcagtggacaacatagaaagatcattaatactctgagatgattgcctattcgtttaaacag

SEQ ID NO: 6001 - DNA, 170 bp, Homo sapiens
tccctggaagtggtccttgccaatctccgagttccttcaaaaagtaagttatactacttaaagcttttaccagaattgtatggtgtctctgctaattttttaaatgaaatacctatgtctaaaatatcattctcagtggacaacatagaaagatcattaatactctgaga

SEQ ID NO: 6002 - DNA, 170 bp, Homo sapiens
cactttcatgcatcactctagttataaataggcatttttagtgtttttgaaatcacagtgccttttaaagagaatttctttccttatagcgtaaagacaatgaccaggtaattgtattttaatttctagatacatttggaattaataacatcacaggtgttatctatgtg

SEQ ID NO: 6003 - DNA, 170 bp, Homo sapiens
gctatgtacttcgagtccaagctgattccctggaagtggtccttgccaatctccgagttccttcaaaaagtaagttatactacttaaagcttttaccagaattgtatggtgtctctgctaattttttaaatgaaatacctatgtctaaaatatcattctcagtggacaac

SEQ ID NO: 6004 - DNA, 170 bp, Homo sapiens
cctctggattatgagaccaggacaagctatgtacttcgagtccaagctgattccctggaagtggtccttgccaatctccgagttccttcaaaaagtaagttatactacttaaagcttttaccagaattgtatggtgtctctgctaattttttaaatgaaatacctatgtc

SEQ ID NO: 6005 - DNA, 170 bp, Homo sapiens
tcacaggtgttatctatgtgaatggacctctggattatgagaccaggacaagctatgtacttcgagtccaagctgattccctggaagtggtccttgccaatctccgagttccttcaaaaagtaagttatactacttaaagcttttaccagaattgtatggtgtctctgct

SEQ ID NO: 6006 - DNA, 170 bp, Homo sapiens
tctagatacatttggaattaataacatcacaggtgttatctatgtgaatggacctctggattatgagaccaggacaagctatgtacttcgagtccaagctgattccctggaagtggtccttgccaatctccgagttccttcaaaaagtaagttatactacttaaagcttt

SEQ ID NO: 6007 - DNA, 170 bp, Homo sapiens
acaatgaccaggtaattgtattttaatttctagatacatttggaattaataacatcacaggtgttatctatgtgaatggacctctggattatgagaccaggacaagctatgtacttcgagtccaagctgattccctggaagtggtccttgccaatctccgagttccttca

SEQ ID NO: 6008 - DNA, 170 bp, Homo sapiens
tttctttccttatagcgtaaagacaatgaccaggtaattgtattttaatttctagatacatttggaattaataacatcacaggtgttatctatgtgaatggacctctggattatgagaccaggacaagctatgtacttcgagtccaagctgattccctggaagtggtcct

SEQ ID NO: 6009 - DNA, 170 bp, Homo sapiens
aatcacagtgccttttaaagagaatttctttccttatagcgtaaagacaatgaccaggtaattgtattttaatttctagatacatttggaattaataacatcacaggtgttatctatgtgaatggacctctggattatgagaccaggacaagctatgtacttcgagtcca

SEQ ID NO: 6010 - DNA, 170 bp, Homo sapiens
aaataggcatttttagtgtttttgaaatcacagtgccttttaaagagaatttctttccttatagcgtaaagacaatgaccaggtaattgtattttaatttctagatacatttggaattaataacatcacaggtgttatctatgtgaatggacctctggattatgagacca

SEQ ID NO: 6011 - DNA, 170 bp, Homo sapiens
tgtttacttctgtactcagagtgaaggtatgcggaattatgttaatatacagaactaaagtaaaagctcaggttttgcagataagctgtaagcctgtagtttgcattaactgcatacttatgctgtataaacaaaagcctgaaacttggagctatattagtttagttatc

SEQ ID NO: 6012 - DNA, 170 bp, Homo sapiens
cggaggtgtatctgaagatgcaagaatgtttacttctgtactcagagtgaaggtatgcggaattatgttaatatacagaactaaagtaaaagctcaggttttgcagataagctgtaagcctgtagtttgcattaactgcatacttatgctgtataaacaaaagcctgaaa

SEQ ID NO: 6013 - DNA, 170 bp, Homo sapiens
cccagtgtttcagaaaaaattctacatcggaggtgtatctgaagatgcaagaatgtttacttctgtactcagagtgaaggtatgcggaattatgttaatatacagaactaaagtaaaagctcaggttttgcagataagctgtaagcctgtagtttgcattaactgcatac

SEQ ID NO: 6014 - DNA, 170 bp, Homo sapiens
gattcaggatgaaaataatcatcccccagtgtttcagaaaaaattctacatcggaggtgtatctgaagatgcaagaatgtttacttctgtactcagagtgaaggtatgcggaattatgttaatatacagaactaaagtaaaagctcaggttttgcagataagctgtaagc

SEQ ID NO: 6015 - DNA, 170 bp, Homo sapiens
ggcaatacagctaaagtatacattgagattcaggatgaaaataatcatcccccagtgtttcagaaaaaattctacatcggaggtgtatctgaagatgcaagaatgtttacttctgtactcagagtgaaggtatgcggaattatgttaatatacagaactaaagtaaaagc

SEQ ID NO: 6016 - DNA, 170 bp, Homo sapiens
aaatgcatcgtttcttgtcctccaggcaatacagctaaagtatacattgagattcaggatgaaaataatcatcccccagtgtttcagaaaaaattctacatcggaggtgtatctgaagatgcaagaatgtttacttctgtactcagagtgaaggtatgcggaattatgtt

SEQ ID NO: 6017 - DNA, 170 bp, Homo sapiens
ccccatgaataaccaccaataaaaaatgcatcgtttcttgtcctccaggcaatacagctaaagtatacattgagattcaggatgaaaataatcatcccccagtgtttcagaaaaaattctacatcggaggtgtatctgaagatgcaagaatgtttacttctgtactcaga

SEQ ID NO: 6018 - DNA, 170 bp, Homo sapiens
tatttacttcagtgcattttttcccccatgaataaccaccaataaaaaatgcatcgtttcttgtcctccaggcaatacagctaaagtatacattgagattcaggatgaaaataatcatcccccagtgtttcagaaaaaattctacatcggaggtgtatctgaagatgcaa

SEQ ID NO: 6019 - DNA, 170 bp, Homo sapiens
tcaatgtttccaaaaaaaagtgcagcaaatatttacttcagtgcattttttcccccatgaataaccaccaataaaaaatgcatcgtttcttgtcctccaggcaatacagctaaagtatacattgagattcaggatgaaaataatcatcccccagtgtttcagaaaaaatt

SEQ ID NO: 6020 - DNA, 170 bp, Homo sapiens
ctagaaatggcttttgatttattttcaatgtttccaaaaaaaagtgcagcaaatatttacttcagtgcattttttcccccatgaataaccaccaataaaaaatgcatcgtttcttgtcctccaggcaatacagctaaagtatacattgagattcaggatgaaaataatca

SEQ ID NO: 6021 - DNA, 170 bp, Homo sapiens
atgggaagggactgagcggcaaagccgatgtactcgtaagtagataaaacttcaggaaagggaagtagctacgatactagccataggtcagtgttttcagtttatagaacttctaagattaatttaaaacgggttttcaaaaacataattattattttcactcagattgt

SEQ ID NO: 6022 - DNA, 170 bp, Homo sapiens
tcaagtttcaagttattgcaactgacgactatgggaagggactgagcggcaaagccgatgtactcgtaagtagataaaacttcaggaaagggaagtagctacgatactagccataggtcagtgttttcagtttatagaacttctaagattaatttaaaacgggttttcaa

SEQ ID NO: 6023 - DNA, 170 bp, Homo sapiens
caaaagtaagccatttcataagggttatcttttcctgcttaattataatctctttttttttcccctccgtctaggctactgataaagatactggcaattatagtgtcatggcctacagactcataataccaccaattaaagagggaaaagaaggatttgtagtggaaaca

SEQ ID NO: 6024 - DNA, 170 bp, Homo sapiens
acataagaaacctcattcttacaaacaaaagtaagccatttcataagggttatcttttcctgcttaattataatctctttttttttcccctccgtctaggctactgataaagatactggcaattatagtgtcatggcctacagactcataataccaccaattaaagaggg

SEQ ID NO: 6025 - DNA, 170 bp, Homo sapiens
aggagggctttattgtgttattattacataagaaacctcattcttacaaacaaaagtaagccatttcataagggttatcttttcctgcttaattataatctctttttttttcccctccgtctaggctactgataaagatactggcaattatagtgtcatggcctacagac

SEQ ID NO: 6026 - DNA, 170 bp, Homo sapiens
cttccataatatgaggagatcctacttcaagtttcaagttattgcaactgacgactatgggaagggactgagcggcaaagccgatgtactcgtaagtagataaaacttcaggaaagggaagtagctacgatactagccataggtcagtgttttcagtttatagaacttct

SEQ ID NO: 6027 - DNA, 170 bp, Homo sapiens
agggcttatcaaaactgctatgctcttccataatatgaggagatcctacttcaagtttcaagttattgcaactgacgactatgggaagggactgagcggcaaagccgatgtactcgtaagtagataaaacttcaggaaagggaagtagctacgatactagccataggtca

SEQ ID NO: 6028 - DNA, 170 bp, Homo sapiens
aggatttgtagtggaaacatatacagggcttatcaaaactgctatgctcttccataatatgaggagatcctacttcaagtttcaagttattgcaactgacgactatgggaagggactgagcggcaaagccgatgtactcgtaagtagataaaacttcaggaaagggaagt

SEQ ID NO: 6029 - DNA, 170 bp, Homo sapiens
taccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtaagt

SEQ ID NO: 6030 - DNA, 170 bp, Homo sapiens
gtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagc

SEQ ID NO: 6031 - DNA, 170 bp, Homo sapiens
gctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgc

SEQ ID NO: 6032 - DNA, 170 bp, Homo sapiens
tttttttttcccctccgtctaggctactgataaagatactggcaattatagtgtcatggcctacagactcataataccaccaattaaagagggaaaagaaggatttgtagtggaaacatatacagggcttatcaaaactgctatgctcttccataatatgaggagatcct

SEQ ID NO: 6033 - DNA, 170 bp, Homo sapiens
gttatcttttcctgcttaattataatctctttttttttcccctccgtctaggctactgataaagatactggcaattatagtgtcatggcctacagactcataataccaccaattaaagagggaaaagaaggatttgtagtggaaacatatacagggcttatcaaaactgc

SEQ ID NO: 6034 - DNA, 170 bp, Homo sapiens
gtggaaaaaaagatagaagatcttacagagtaattgattttgtctccttatatatttatttttatatgaccatgatttttaactgtattttttaaattttattttagattcaggggatacatgtgcaggtgtgttacatggatatattgcatattggtgaggtttaggct

SEQ ID NO: 6035 - DNA, 170 bp, Homo sapiens
ccaatgtgcctcctactctagtggaaaaaaagatagaagatcttacagagtaattgattttgtctccttatatatttatttttatatgaccatgatttttaactgtattttttaaattttattttagattcaggggatacatgtgcaggtgtgttacatggatatattgc

SEQ ID NO: 6036 - DNA, 170 bp, Homo sapiens
tcagctggatatgcaagtcattgtttccaatgtgcctcctactctagtggaaaaaaagatagaagatcttacagagtaattgattttgtctccttatatatttatttttatatgaccatgatttttaactgtattttttaaattttattttagattcaggggatacatgt

SEQ ID NO: 6037 - DNA, 170 bp, Homo sapiens
cttctttcaggtctccgtggtcaatcagctggatatgcaagtcattgtttccaatgtgcctcctactctagtggaaaaaaagatagaagatcttacagagtaattgattttgtctccttatatatttatttttatatgaccatgatttttaactgtattttttaaatttt

SEQ ID NO: 6038 - DNA, 170 bp, Homo sapiens
agtaaaaattaaatgaattctgttttttcttctttcaggtctccgtggtcaatcagctggatatgcaagtcattgtttccaatgtgcctcctactctagtggaaaaaaagatagaagatcttacagagtaattgattttgtctccttatatatttatttttatatgacca

SEQ ID NO: 6039 - DNA, 170 bp, Homo sapiens
gggggttttctgattatggaaatttcagtgagtaaaaattaaatgaattctgttttttcttctttcaggtctccgtggtcaatcagctggatatgcaagtcattgtttccaatgtgcctcctactctagtggaaaaaaagatagaagatcttacagagtaattgattttg

SEQ ID NO: 6040 - DNA, 170 bp, Homo sapiens
agtagggaagaggtaatgtgggggttttctgattatggaaatttcagtgagtaaaaattaaatgaattctgttttttcttctttcaggtctccgtggtcaatcagctggatatgcaagtcattgtttccaatgtgcctcctactctagtggaaaaaaagatagaagatct

SEQ ID NO: 6041 - DNA, 170 bp, Homo sapiens
tcagaaaccactgtgtctatgcatagtagggaagaggtaatgtgggggttttctgattatggaaatttcagtgagtaaaaattaaatgaattctgttttttcttctttcaggtctccgtggtcaatcagctggatatgcaagtcattgtttccaatgtgcctcctactct

SEQ ID NO: 6042 - DNA, 170 bp, Homo sapiens
tgtatatatatttgttcctgaatttgaaaatcagaaaccactgtgtctatgcatagtagggaagaggtaatgtgggggttttctgattatggaaatttcagtgagtaaaaattaaatgaattctgttttttcttctttcaggtctccgtggtcaatcagctggatatgca

SEQ ID NO: 6043 - DNA, 170 bp, Homo sapiens
cgatagaaatgagctttttaagtaagtgctttttgttatctgtaacagctctttggttacaatagcaaccatagatgattctgacttgaggctataagtacttaaagtttaaaacccaccaaatagttactgaaagtgaagtgtaagcaaagaacctgaaatacctagga

SEQ ID NO: 6044 - DNA, 170 bp, Homo sapiens
acccccaaaccaacagagccatcgatagaaatgagctttttaagtaagtgctttttgttatctgtaacagctctttggttacaatagcaaccatagatgattctgacttgaggctataagtacttaaagtttaaaacccaccaaatagttactgaaagtgaagtgtaagc

SEQ ID NO: 6045 - DNA, 170 bp, Homo sapiens
catttttcatttactaaatgtcttttcaagttaagagtaattttttactcccagaaagcccattggactgtcatgtttgtactttgtttgatttataggatcttggatcgctatgttcaggaacaaattcctggtgccaaggtcgtagtggagtccattggagctcgccg

SEQ ID NO: 6046 - DNA, 170 bp, Homo sapiens
attaacaaaaaactaggctgtcatcatttttcatttactaaatgtcttttcaagttaagagtaattttttactcccagaaagcccattggactgtcatgtttgtactttgtttgatttataggatcttggatcgctatgttcaggaacaaattcctggtgccaaggtcgt

SEQ ID NO: 6047 - DNA, 170 bp, Homo sapiens
ttcaagggtttatattcagtaaacattaacaaaaaactaggctgtcatcatttttcatttactaaatgtcttttcaagttaagagtaattttttactcccagaaagcccattggactgtcatgtttgtactttgtttgatttataggatcttggatcgctatgttcagga

SEQ ID NO: 6048 - DNA, 170 bp, Homo sapiens
aatgtgacttgactgtctatgcaattgacccccaaaccaacagagccatcgatagaaatgagctttttaagtaagtgctttttgttatctgtaacagctctttggttacaatagcaaccatagatgattctgacttgaggctataagtacttaaagtttaaaacccacca

SEQ ID NO: 6049 - DNA, 170 bp, Homo sapiens
gatgccttttccctagaagattacaccaaatgtgacttgactgtctatgcaattgacccccaaaccaacagagccatcgatagaaatgagctttttaagtaagtgctttttgttatctgtaacagctctttggttacaatagcaaccatagatgattctgacttgaggct

SEQ ID NO: 6050 - DNA, 170 bp, Homo sapiens
ggagctcgccggcatggagatgccttttccctagaagattacaccaaatgtgacttgactgtctatgcaattgacccccaaaccaacagagccatcgatagaaatgagctttttaagtaagtgctttttgttatctgtaacagctctttggttacaatagcaaccataga

SEQ ID NO: 6051 - DNA, 170 bp, Homo sapiens
gtgccaaggtcgtagtggagtccattggagctcgccggcatggagatgccttttccctagaagattacaccaaatgtgacttgactgtctatgcaattgacccccaaaccaacagagccatcgatagaaatgagctttttaagtaagtgctttttgttatctgtaacagc

SEQ ID NO: 6052 - DNA, 170 bp, Homo sapiens
tcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaagt

SEQ ID NO: 6053 - DNA, 170 bp, Homo sapiens
tgtactttgtttgatttataggatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaaca

SEQ ID NO: 6054 - DNA, 170 bp, Homo sapiens
gcccattggactgtcatgtttgtactttgtttgatttataggatcttggatcgctatgttcaggaacaaattcctggtgccaaggtcgtagtggagtccattggagctcgccggcatggagatgccttttccctagaagattacaccaaatgtgacttgactgtctatgc

SEQ ID NO: 6055 - DNA, 170 bp, Homo sapiens
aagttaagagtaattttttactcccagaaagcccattggactgtcatgtttgtactttgtttgatttataggatcttggatcgctatgttcaggaacaaattcctggtgccaaggtcgtagtggagtccattggagctcgccggcatggagatgccttttccctagaaga

SEQ ID NO: 6056 - DNA, 170 bp, Homo sapiens
ggttttggtcagctacagacagtaagtattcaaggatggtaaacctggatagttcctcagaagtcattgcagaaaaccatctctggtaacatggctttgcgttgtaaaatattgatggtgcaactactctgagattgctttatctgtctgtctatctcgtaccaaatgat

SEQ ID NO: 6057 - DNA, 170 bp, Homo sapiens
gctgcattcctgccatcttggtggttttggtcagctacagacagtaagtattcaaggatggtaaacctggatagttcctcagaagtcattgcagaaaaccatctctggtaacatggctttgcgttgtaaaatattgatggtgcaactactctgagattgctttatctgtc

SEQ ID NO: 6058 - DNA, 170 bp, Homo sapiens
gctctttctctgctagcatcattaattttactatttatctaacaataaagatttttggatggcaaactacttgatatcaataaagactttcagccgtattatggggaaggaggacgcattctggagatccggactccagaggcagtgaccagcattaaaaagagaggaga

SEQ ID NO: 6059 - DNA, 170 bp, Homo sapiens
gatcttacaaaaagattttatttttaaaatgctctttctctgctagcatcattaattttactatttatctaacaataaagatttttggatggcaaactacttgatatcaataaagactttcagccgtattatggggaaggaggacgcattctggagatccggactccaga

SEQ ID NO: 6060 - DNA, 170 bp, Homo sapiens
ttcaattagagaaaatattgaaagatcttacaaaaagattttatttttaaaatgctctttctctgctagcatcattaattttactatttatctaacaataaagatttttggatggcaaactacttgatatcaataaagactttcagccgtattatggggaaggaggacgc

SEQ ID NO: 6061 - DNA, 170 bp, Homo sapiens
tcatgagacttctgactcagcttgtgtttcaattagagaaaatattgaaagatcttacaaaaagattttatttttaaaatgctctttctctgctagcatcattaattttactatttatctaacaataaagatttttggatggcaaactacttgatatcaataaagacttt

SEQ ID NO: 6062 - DNA, 170 bp, Homo sapiens
ggctctggccttcatcatcatcctctgctgcattcctgccatcttggtggttttggtcagctacagacagtaagtattcaaggatggtaaacctggatagttcctcagaagtcattgcagaaaaccatctctggtaacatggctttgcgttgtaaaatattgatggtgca

SEQ ID NO: 6063 - DNA, 170 bp, Homo sapiens
tctaggatacacagaaggggccttgttggctctggccttcatcatcatcctctgctgcattcctgccatcttggtggttttggtcagctacagacagtaagtattcaaggatggtaaacctggatagttcctcagaagtcattgcagaaaaccatctctggtaacatggc

SEQ ID NO: 6064 - DNA, 170 bp, Homo sapiens
ccagcattaaaaagagaggagaaagtctaggatacacagaaggggccttgttggctctggccttcatcatcatcctctgctgcattcctgccatcttggtggttttggtcagctacagacagtaagtattcaaggatggtaaacctggatagttcctcagaagtcattgc

SEQ ID NO: 6065 - DNA, 170 bp, Homo sapiens
tccggactccagaggcagtgaccagcattaaaaagagaggagaaagtctaggatacacagaaggggccttgttggctctggccttcatcatcatcctctgctgcattcctgccatcttggtggttttggtcagctacagacagtaagtattcaaggatggtaaacctgga

SEQ ID NO: 6066 - DNA, 170 bp, Homo sapiens
tggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagt

SEQ ID NO: 6067 - DNA, 170 bp, Homo sapiens
tgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgcca

SEQ ID NO: 6068 - DNA, 170 bp, Homo sapiens
aagatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatca

SEQ ID NO: 6069 - DNA, 170 bp, Homo sapiens
aattttactatttatctaacaataaagatttttggatggcaaactacttgatatcaataaagactttcagccgtattatggggaaggaggacgcattctggagatccggactccagaggcagtgaccagcattaaaaagagaggagaaagtctaggatacacagaagggg

SEQ ID NO: 6070 - DNA, 170 bp, Homo sapiens
gaagagttctggatagagatgttagtgattttttttctttgcccctgtaatataagtttattataatttaaatgtctatgtgtgtgtttatatgatattgaattatttacataatttgagtttatttcctgagtatagcaacaacagtttctttaactcatttaaagaag

SEQ ID NO: 6071 - DNA, 170 bp, Homo sapiens
gcaaatgcttttcctgaacagcaccggaagagttctggatagagatgttagtgattttttttctttgcccctgtaatataagtttattataatttaaatgtctatgtgtgtgtttatatgatattgaattatttacataatttgagtttatttcctgagtatagcaacaa

SEQ ID NO: 6072 - DNA, 170 bp, Homo sapiens
gtattttcagctttaaaactgattgtgagccagccgcggtttaagagcatgatctttgctaaagaattcatatgagtagaatatgttttcaagtacctttctttggtttgcaggtacaattctggtggacaacatgctgatcaaagggactgctggaggaccagacccca

SEQ ID NO: 6073 - DNA, 170 bp, Homo sapiens
cttatgctagatatacagttgagtattttcagctttaaaactgattgtgagccagccgcggtttaagagcatgatctttgctaaagaattcatatgagtagaatatgttttcaagtacctttctttggtttgcaggtacaattctggtggacaacatgctgatcaaaggg

SEQ ID NO: 6074 - DNA, 170 bp, Homo sapiens
gggtgttgatggatcctgttaagcaaatgcttttcctgaacagcaccggaagagttctggatagagatgttagtgattttttttctttgcccctgtaatataagtttattataatttaaatgtctatgtgtgtgtttatatgatattgaattatttacataatttgagtt

SEQ ID NO: 6075 - DNA, 170 bp, Homo sapiens
ctttctttaaaggataatgtggattactgggtgttgatggatcctgttaagcaaatgcttttcctgaacagcaccggaagagttctggatagagatgttagtgattttttttctttgcccctgtaatataagtttattataatttaaatgtctatgtgtgtgtttatatg

SEQ ID NO: 6076 - DNA, 170 bp, Homo sapiens
gaccagaccccaccatagaactttctttaaaggataatgtggattactgggtgttgatggatcctgttaagcaaatgcttttcctgaacagcaccggaagagttctggatagagatgttagtgattttttttctttgcccctgtaatataagtttattataatttaaatg

SEQ ID NO: 6077 - DNA, 170 bp, Homo sapiens
acatgctgatcaaagggactgctggaggaccagaccccaccatagaactttctttaaaggataatgtggattactgggtgttgatggatcctgttaagcaaatgcttttcctgaacagcaccggaagagttctggatagagatgttagtgattttttttctttgcccctg

SEQ ID NO: 6078 - DNA, 170 bp, Homo sapiens
tggtttgcaggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagaga

SEQ ID NO: 6079 - DNA, 170 bp, Homo sapiens
agaatatgttttcaagtacctttctttggtttgcaggtacaattctggtggacaacatgctgatcaaagggactgctggaggaccagaccccaccatagaactttctttaaaggataatgtggattactgggtgttgatggatcctgttaagcaaatgcttttcctgaac

SEQ ID NO: 6080 - DNA, 170 bp, Homo sapiens
tctttgctaaagaattcatatgagtagaatatgttttcaagtacctttctttggtttgcaggtacaattctggtggacaacatgctgatcaaagggactgctggaggaccagaccccaccatagaactttctttaaaggataatgtggattactgggtgttgatggatcc

SEQ ID NO: 6081 - DNA, 170 bp, Homo sapiens
agccgcggtttaagagcatgatctttgctaaagaattcatatgagtagaatatgttttcaagtacctttctttggtttgcaggtacaattctggtggacaacatgctgatcaaagggactgctggaggaccagaccccaccatagaactttctttaaaggataatgtgga

SEQ ID NO: 6082 - DNA, 170 bp, Homo sapiens
ttcccaaacaggtttaaagtgtaagtataattaacattttacacatccttttcatgtaataggaaaagagaaacccgagattatatcaatcaagtcagcctgctcagaaccacatcttattcccttgttttgcgtttgtaatagtttatttcttggtttgatatatatag

SEQ ID NO: 6083 - DNA, 170 bp, Homo sapiens
taatgtagctttctatttttcttactcttgctttcccaaacaggtttaaagtgtaagtataattaacattttacacatccttttcatgtaataggaaaagagaaacccgagattatatcaatcaagtcagcctgctcagaaccacatcttattcccttgttttgcgtttg

SEQ ID NO: 6084 - DNA, 170 bp, Homo sapiens
atgttattaatgcaatagttctaatgtagctttctatttttcttactcttgctttcccaaacaggtttaaagtgtaagtataattaacattttacacatccttttcatgtaataggaaaagagaaacccgagattatatcaatcaagtcagcctgctcagaaccacatct

SEQ ID NO: 6085 - DNA, 170 bp, Homo sapiens
gatttagaataaatcagatgttaaaatgttattaatgcaatagttctaatgtagctttctatttttcttactcttgctttcccaaacaggtttaaagtgtaagtataattaacattttacacatccttttcatgtaataggaaaagagaaacccgagattatatcaatca

SEQ ID NO: 6086 - DNA, 170 bp, Homo sapiens
tgaatttaacgtataaattattcatgatttagaataaatcagatgttaaaatgttattaatgcaatagttctaatgtagctttctatttttcttactcttgctttcccaaacaggtttaaagtgtaagtataattaacattttacacatccttttcatgtaataggaaaa

SEQ ID NO: 6087 - DNA, 170 bp, Homo sapiens
tctgtcattaactctgtcattatgaatttaacgtataaattattcatgatttagaataaatcagatgttaaaatgttattaatgcaatagttctaatgtagctttctatttttcttactcttgctttcccaaacaggtttaaagtgtaagtataattaacattttacaca

SEQ ID NO: 6088 - DNA, 170 bp, Homo sapiens
gaacttggagacagctcaatgtaagtagaccgttcaggaactctgagaagtagttgggttttactgaattctgtgtggtgagtatttaatttcaatctgatgtggaaatgcctacatggactatttattttattctattattttcaagagaaaatttgttaagacgaaaa

SEQ ID NO: 6089 - DNA, 170 bp, Homo sapiens
ccaggtgcgcatctctatgaagaacttggagacagctcaatgtaagtagaccgttcaggaactctgagaagtagttgggttttactgaattctgtgtggtgagtatttaatttcaatctgatgtggaaatgcctacatggactatttattttattctattattttcaaga

SEQ ID NO: 6090 - DNA, 170 bp, Homo sapiens
gtgtaaaataattttagtgggttcccctgataactggaccccattattaaaaggtggcttattgataagcattatgatttctaaaatgagttttacaagccatccttactttatccaagacgtcaagctgagtgtacaaagactgcacgaattcaggccgcattacccgc

SEQ ID NO: 6091 - DNA, 170 bp, Homo sapiens
tctgtttataaattgatgtttgtgtaaaataattttagtgggttcccctgataactggaccccattattaaaaggtggcttattgataagcattatgatttctaaaatgagttttacaagccatccttactttatccaagacgtcaagctgagtgtacaaagactgcacg

SEQ ID NO: 6092 - DNA, 170 bp, Homo sapiens
gcccccgccgccgccgccgcctccgccaggtgcgcatctctatgaagaacttggagacagctcaatgtaagtagaccgttcaggaactctgagaagtagttgggttttactgaattctgtgtggtgagtatttaatttcaatctgatgtggaaatgcctacatggactat

SEQ ID NO: 6093 - DNA, 170 bp, Homo sapiens
tgccggctcctgcaccagtggcagcgcccccgccgccgccgccgcctccgccaggtgcgcatctctatgaagaacttggagacagctcaatgtaagtagaccgttcaggaactctgagaagtagttgggttttactgaattctgtgtggtgagtatttaatttcaatctg

SEQ ID NO: 6094 - DNA, 170 bp, Homo sapiens
gcattacccgcggctaaaccagcagtgccggctcctgcaccagtggcagcgcccccgccgccgccgccgcctccgccaggtgcgcatctctatgaagaacttggagacagctcaatgtaagtagaccgttcaggaactctgagaagtagttgggttttactgaattctgt

SEQ ID NO: 6095 - DNA, 170 bp, Homo sapiens
agtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgtaagtagaccgttcaggaactctg

SEQ ID NO: 6096 - DNA, 170 bp, Homo sapiens
ccttactttatccaagacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctca

SEQ ID NO: 6097 - DNA, 170 bp, Homo sapiens
tgatttctaaaatgagttttacaagccatccttactttatccaagacgtcaagctgagtgtacaaagactgcacgaattcaggccgcattacccgcggctaaaccagcagtgccggctcctgcaccagtggcagcgcccccgccgccgccgccgcctccgccaggtgcgc

SEQ ID NO: 6098 - DNA, 170 bp, Homo sapiens
aaaggtggcttattgataagcattatgatttctaaaatgagttttacaagccatccttactttatccaagacgtcaagctgagtgtacaaagactgcacgaattcaggccgcattacccgcggctaaaccagcagtgccggctcctgcaccagtggcagcgcccccgccg

SEQ ID NO: 6099 - DNA, 170 bp, Homo sapiens
cctgataactggaccccattattaaaaggtggcttattgataagcattatgatttctaaaatgagttttacaagccatccttactttatccaagacgtcaagctgagtgtacaaagactgcacgaattcaggccgcattacccgcggctaaaccagcagtgccggctcct

SEQ ID NO: 6100 - DNA, 170 bp, Homo sapiens
acaatctcacagtcaatctacttcactgtaatgttgcttttcttattttagtcgggcaaacctcttgttgatcatagtcttcaagttgaacatcaaatttgaacgtcaaagaagactctattattttaccccaaattcaatgaaatgcagttttttttctcgtttttaat

SEQ ID NO: 6101 - DNA, 170 bp, Homo sapiens
attgtcgagggaactgaaaaacaatctcacagtcaatctacttcactgtaatgttgcttttcttattttagtcgggcaaacctcttgttgatcatagtcttcaagttgaacatcaaatttgaacgtcaaagaagactctattattttaccccaaattcaatgaaatgcag

SEQ ID NO: 6102 - DNA, 170 bp, Homo sapiens
cagctatcaacaacgacagtgtgtaaaacagaccctcagagagaaccaaaaggcatcctcagacacgttaaaaacttagcagaacttgaaaaatcagtagctaacatgtacagtcaaatagaaaaaaactatctacgcacaaatgtttcagaacttcaaactatgtgccc

SEQ ID NO: 6103 - DNA, 170 bp, Homo sapiens
gccgagaaaattaagtcctctatgacacagctatcaacaacgacagtgtgtaaaacagaccctcagagagaaccaaaaggcatcctcagacacgttaaaaacttagcagaacttgaaaaatcagtagctaacatgtacagtcaaatagaaaaaaactatctacgcacaaa

SEQ ID NO: 6104 - DNA, 170 bp, Homo sapiens
tgcacgaccaacttgatgcctgccgagaaaattaagtcctctatgacacagctatcaacaacgacagtgtgtaaaacagaccctcagagagaaccaaaaggcatcctcagacacgttaaaaacttagcagaacttgaaaaatcagtagctaacatgtacagtcaaataga

SEQ ID NO: 6105 - DNA, 170 bp, Homo sapiens
acagagtgtgtctgtataacaggtgttaaatgcacgaccaacttgatgcctgccgagaaaattaagtcctctatgacacagctatcaacaacgacagtgtgtaaaacagaccctcagagagaaccaaaaggcatcctcagacacgttaaaaacttagcagaacttgaaaa

SEQ ID NO: 6106 - DNA, 170 bp, Homo sapiens
cctccttcagcttcatttctgtccacagagtgtgtctgtataacaggtgttaaatgcacgaccaacttgatgcctgccgagaaaattaagtcctctatgacacagctatcaacaacgacagtgtgtaaaacagaccctcagagagaaccaaaaggcatcctcagacacgt

SEQ ID NO: 6107 - DNA, 170 bp, Homo sapiens
cctccttctattccttgccctccacctccttcagcttcatttctgtccacagagtgtgtctgtataacaggtgttaaatgcacgaccaacttgatgcctgccgagaaaattaagtcctctatgacacagctatcaacaacgacagtgtgtaaaacagaccctcagagaga

SEQ ID NO: 6108 - DNA, 170 bp, Homo sapiens
tttccaactcctcttcctccaccacctccttctattccttgccctccacctccttcagcttcatttctgtccacagagtgtgtctgtataacaggtgttaaatgcacgaccaacttgatgcctgccgagaaaattaagtcctctatgacacagctatcaacaacgacagt

SEQ ID NO: 6109 - DNA, 170 bp, Homo sapiens
ccccaacaccacctcttctacctccatttccaactcctcttcctccaccacctccttctattccttgccctccacctccttcagcttcatttctgtccacagagtgtgtctgtataacaggtgttaaatgcacgaccaacttgatgcctgccgagaaaattaagtcctct

SEQ ID NO: 6110 - DNA, 170 bp, Homo sapiens
tccactttccgtttcaacgtctggtcccccaacaccacctcttctacctccatttccaactcctcttcctccaccacctccttctattccttgccctccacctccttcagcttcatttctgtccacagagtgtgtctgtataacaggtgttaaatgcacgaccaacttga

SEQ ID NO: 6111 - DNA, 170 bp, Homo sapiens
cctcttcctcctcctacattttttccactttccgtttcaacgtctggtcccccaacaccacctcttctacctccatttccaactcctcttcctccaccacctccttctattccttgccctccacctccttcagcttcatttctgtccacagagtgtgtctgtataacagg

SEQ ID NO: 6112 - DNA, 170 bp, Homo sapiens
atctgaacaaaacaaggggagtttgaacaatattgtcgagggaactgaaaaacaatctcacagtcaatctacttcactgtaatgttgcttttcttattttagtcgggcaaacctcttgttgatcatagtcttcaagttgaacatcaaatttgaacgtcaaagaagactct

SEQ ID NO: 6113 - DNA, 170 bp, Homo sapiens
cctccctctcctccttctatccctcttcctcttcctcctcctacattttttccactttccgtttcaacgtctggtcccccaacaccacctcttctacctccatttccaactcctcttcctccaccacctccttctattccttgccctccacctccttcagcttcatttct

SEQ ID NO: 6114 - DNA, 170 bp, Homo sapiens
tctcctttttctcttttttgtcctcctccctctcctccttctatccctcttcctcttcctcctcctacattttttccactttccgtttcaacgtctggtcccccaacaccacctcttctacctccatttccaactcctcttcctccaccacctccttctattccttgccc

SEQ ID NO: 6115 - DNA, 170 bp, Homo sapiens
cctcttgctcctcctcctgacatttctcctttttctcttttttgtcctcctccctctcctccttctatccctcttcctcttcctcctcctacattttttccactttccgtttcaacgtctggtcccccaacaccacctcttctacctccatttccaactcctcttcctcc

SEQ ID NO: 6116 - DNA, 170 bp, Homo sapiens
cctccttctcctcctcctgctcctgctcctcttgctcctcctcctgacatttctcctttttctcttttttgtcctcctccctctcctccttctatccctcttcctcttcctcctcctacattttttccactttccgtttcaacgtctggtcccccaacaccacctcttct

SEQ ID NO: 6117 - DNA, 170 bp, Homo sapiens
tccccctcctcctcctatttctcctccttctcctcctcctgctcctgctcctcttgctcctcctcctgacatttctcctttttctcttttttgtcctcctccctctcctccttctatccctcttcctcttcctcctcctacattttttccactttccgtttcaacgtctg

SEQ ID NO: 6118 - DNA, 170 bp, Homo sapiens
caaacatctctccttctgcctgtccccttccccctcctcctcctatttctcctccttctcctcctcctgctcctgctcctcttgctcctcctcctgacatttctcctttttctcttttttgtcctcctccctctcctccttctatccctcttcctcttcctcctcctaca

SEQ ID NO: 6119 - DNA, 170 bp, Homo sapiens
atatttttgaaaattttgcccatccaccaaacatctctccttctgcctgtccccttccccctcctcctcctatttctcctccttctcctcctcctgctcctgctcctcttgctcctcctcctgacatttctcctttttctcttttttgtcctcctccctctcctccttct

SEQ ID NO: 6120 - DNA, 170 bp, Homo sapiens
acctattgaaaccgaaagaaatatttttgaaaattttgcccatccaccaaacatctctccttctgcctgtccccttccccctcctcctcctatttctcctccttctcctcctcctgctcctgctcctcttgctcctcctcctgacatttctcctttttctcttttttgtc

SEQ ID NO: 6121 - DNA, 170 bp, Homo sapiens
tctaggagagagacacctatttgtatgttacctattgaaaccgaaagaaatatttttgaaaattttgcccatccaccaaacatctctccttctgcctgtccccttccccctcctcctcctatttctcctccttctcctcctcctgctcctgctcctcttgctcctcctcc

SEQ ID NO: 6122 - DNA, 170 bp, Homo sapiens
ggccttgtgttttacattcttcactctctaggagagagacacctatttgtatgttacctattgaaaccgaaagaaatatttttgaaaattttgcccatccaccaaacatctctccttctgcctgtccccttccccctcctcctcctatttctcctccttctcctcctcct

SEQ ID NO: 6123 - DNA, 170 bp, Homo sapiens
agaagtaacaaatatggaaatcacatctgaacaaaacaaggggagtttgaacaatattgtcgagggaactgaaaaacaatctcacagtcaatctacttcactgtaatgttgcttttcttattttagtcgggcaaacctcttgttgatcatagtcttcaagttgaacatca

SEQ ID NO: 6124 - DNA, 170 bp, Homo sapiens
tgttccttggaactttctccttcaaggccttgtgttttacattcttcactctctaggagagagacacctatttgtatgttacctattgaaaccgaaagaaatatttttgaaaattttgcccatccaccaaacatctctccttctgcctgtccccttccccctcctcctcc

SEQ ID NO: 6125 - DNA, 170 bp, Homo sapiens
tgtcatcagttctcctgctgagtgttccttggaactttctccttcaaggccttgtgttttacattcttcactctctaggagagagacacctatttgtatgttacctattgaaaccgaaagaaatatttttgaaaattttgcccatccaccaaacatctctccttctgcct

SEQ ID NO: 6126 - DNA, 170 bp, Homo sapiens
actgtggaactcaaatcagaacctaatgtcatcagttctcctgctgagtgttccttggaactttctccttcaaggccttgtgttttacattcttcactctctaggagagagacacctatttgtatgttacctattgaaaccgaaagaaatatttttgaaaattttgccca

SEQ ID NO: 6127 - DNA, 170 bp, Homo sapiens
ccactttgccaactgtttcaagaactgtggaactcaaatcagaacctaatgtcatcagttctcctgctgagtgttccttggaactttctccttcaaggccttgtgttttacattcttcactctctaggagagagacacctatttgtatgttacctattgaaaccgaaaga

SEQ ID NO: 6128 - DNA, 170 bp, Homo sapiens
ttcccaggcctcacttctcattctccactttgccaactgtttcaagaactgtggaactcaaatcagaacctaatgtcatcagttctcctgctgagtgttccttggaactttctccttcaaggccttgtgttttacattcttcactctctaggagagagacacctatttgt

SEQ ID NO: 6129 - DNA, 170 bp, Homo sapiens
ctctctcttcagactcttcattttgctttcccaggcctcacttctcattctccactttgccaactgtttcaagaactgtggaactcaaatcagaacctaatgtcatcagttctcctgctgagtgttccttggaactttctccttcaaggccttgtgttttacattcttca

SEQ ID NO: 6130 - DNA, 170 bp, Homo sapiens
tgatagaaggaacagaacagttgaaatctctctcttcagactcttcattttgctttcccaggcctcacttctcattctccactttgccaactgtttcaagaactgtggaactcaaatcagaacctaatgtcatcagttctcctgctgagtgttccttggaactttctcct

SEQ ID NO: 6131 - DNA, 170 bp, Homo sapiens
aaggcaaggtgaaacactgatgatagaaggaacagaacagttgaaatctctctcttcagactcttcattttgctttcccaggcctcacttctcattctccactttgccaactgtttcaagaactgtggaactcaaatcagaacctaatgtcatcagttctcctgctgagt

SEQ ID NO: 6132 - DNA, 170 bp, Homo sapiens
gaggcaaatttgacagagaaagaggaaataaggcaaggtgaaacactgatgatagaaggaacagaacagttgaaatctctctcttcagactcttcattttgctttcccaggcctcacttctcattctccactttgccaactgtttcaagaactgtggaactcaaatcaga

SEQ ID NO: 6133 - DNA, 170 bp, Homo sapiens
gcagcaatccattgcttacaactgaagaggcaaatttgacagagaaagaggaaataaggcaaggtgaaacactgatgatagaaggaacagaacagttgaaatctctctcttcagactcttcattttgctttcccaggcctcacttctcattctccactttgccaactgtt

SEQ ID NO: 6134 - DNA, 170 bp, Homo sapiens
ttcagaacttcaaactatgtgcccttcagaagtaacaaatatggaaatcacatctgaacaaaacaaggggagtttgaacaatattgtcgagggaactgaaaaacaatctcacagtcaatctacttcactgtaatgttgcttttcttattttagtcgggcaaacctcttgt

SEQ ID NO: 6135 - DNA, 170 bp, Homo sapiens
tggaatctgtacaaacaaaagaggtagcagcaatccattgcttacaactgaagaggcaaatttgacagagaaagaggaaataaggcaaggtgaaacactgatgatagaaggaacagaacagttgaaatctctctcttcagactcttcattttgctttcccaggcctcact

SEQ ID NO: 6136 - DNA, 170 bp, Homo sapiens
ggcagaaagctgaaaatgaaaacactggaatctgtacaaacaaaagaggtagcagcaatccattgcttacaactgaagaggcaaatttgacagagaaagaggaaataaggcaaggtgaaacactgatgatagaaggaacagaacagttgaaatctctctcttcagactct

SEQ ID NO: 6137 - DNA, 170 bp, Homo sapiens
gcagcagtggcaaggcaccaggcagaaagctgaaaatgaaaacactggaatctgtacaaacaaaagaggtagcagcaatccattgcttacaactgaagaggcaaatttgacagagaaagaggaaataaggcaaggtgaaacactgatgatagaaggaacagaacagttga

SEQ ID NO: 6138 - DNA, 170 bp, Homo sapiens
ttccaaatagaccagagatcatagatctgcagcagtggcaaggcaccaggcagaaagctgaaaatgaaaacactggaatctgtacaaacaaaagaggtagcagcaatccattgcttacaactgaagaggcaaatttgacagagaaagaggaaataaggcaaggtgaaaca

SEQ ID NO: 6139 - DNA, 170 bp, Homo sapiens
cccaggaggctgatgaggaaagttccaaatagaccagagatcatagatctgcagcagtggcaaggcaccaggcagaaagctgaaaatgaaaacactggaatctgtacaaacaaaagaggtagcagcaatccattgcttacaactgaagaggcaaatttgacagagaaaga

SEQ ID NO: 6140 - DNA, 170 bp, Homo sapiens
aggctgtggagtcagtcagtcagcttacccaggaggctgatgaggaaagttccaaatagaccagagatcatagatctgcagcagtggcaaggcaccaggcagaaagctgaaaatgaaaacactggaatctgtacaaacaaaagaggtagcagcaatccattgcttacaac

SEQ ID NO: 6141 - DNA, 170 bp, Homo sapiens
ggggcccaagagaaaagattcagaggctgtggagtcagtcagtcagcttacccaggaggctgatgaggaaagttccaaatagaccagagatcatagatctgcagcagtggcaaggcaccaggcagaaagctgaaaatgaaaacactggaatctgtacaaacaaaagaggt

SEQ ID NO: 6142 - DNA, 170 bp, Homo sapiens
aatacaagccaagagtaagtctctgaggggcccaagagaaaagattcagaggctgtggagtcagtcagtcagcttacccaggaggctgatgaggaaagttccaaatagaccagagatcatagatctgcagcagtggcaaggcaccaggcagaaagctgaaaatgaaaaca

SEQ ID NO: 6143 - DNA, 170 bp, Homo sapiens
acagattttgtagacccattttcacccaaaatacaagccaagagtaagtctctgaggggcccaagagaaaagattcagaggctgtggagtcagtcagtcagcttacccaggaggctgatgaggaaagttccaaatagaccagagatcatagatctgcagcagtggcaagg

SEQ ID NO: 6144 - DNA, 170 bp, Homo sapiens
aaattcagacatttcacagagaacagattttgtagacccattttcacccaaaatacaagccaagagtaagtctctgaggggcccaagagaaaagattcagaggctgtggagtcagtcagtcagcttacccaggaggctgatgaggaaagttccaaatagaccagagatca

SEQ ID NO: 6145 - DNA, 170 bp, Homo sapiens
aaaaaactatctacgcacaaatgtttcagaacttcaaactatgtgcccttcagaagtaacaaatatggaaatcacatctgaacaaaacaaggggagtttgaacaatattgtcgagggaactgaaaaacaatctcacagtcaatctacttcactgtaatgttgcttttctt

SEQ ID NO: 6146 - DNA, 170 bp, Homo sapiens
aaggaaaacataagtcaagtatcaacaaattcagacatttcacagagaacagattttgtagacccattttcacccaaaatacaagccaagagtaagtctctgaggggcccaagagaaaagattcagaggctgtggagtcagtcagtcagcttacccaggaggctgatgag

SEQ ID NO: 6147 - DNA, 170 bp, Homo sapiens
acttaagtgcccataatcccctttataaggaaaacataagtcaagtatcaacaaattcagacatttcacagagaacagattttgtagacccattttcacccaaaatacaagccaagagtaagtctctgaggggcccaagagaaaagattcagaggctgtggagtcagtca

SEQ ID NO: 6148 - DNA, 170 bp, Homo sapiens
aaattcacatttctatctgatgaggatgacttaagtgcccataatcccctttataaggaaaacataagtcaagtatcaacaaattcagacatttcacagagaacagattttgtagacccattttcacccaaaatacaagccaagagtaagtctctgaggggcccaagaga

SEQ ID NO: 6149 - DNA, 170 bp, Homo sapiens
caaactgaagtctgcaagaaaattcacatttctatctgatgaggatgacttaagtgcccataatcccctttataaggaaaacataagtcaagtatcaacaaattcagacatttcacagagaacagattttgtagacccattttcacccaaaatacaagccaagagtaagt

SEQ ID NO: 6150 - DNA, 170 bp, Homo sapiens
tgtagacggatcacttaagagcaacaaactgaagtctgcaagaaaattcacatttctatctgatgaggatgacttaagtgcccataatcccctttataaggaaaacataagtcaagtatcaacaaattcagacatttcacagagaacagattttgtagacccattttcac

SEQ ID NO: 6151 - DNA, 170 bp, Homo sapiens
actattgaggctcacaagtcagctcatgtagacggatcacttaagagcaacaaactgaagtctgcaagaaaattcacatttctatctgatgaggatgacttaagtgcccataatcccctttataaggaaaacataagtcaagtatcaacaaattcagacatttcacagag

SEQ ID NO: 6152 - DNA, 170 bp, Homo sapiens
caagttgtgatgcccttttcttccaatactattgaggctcacaagtcagctcatgtagacggatcacttaagagcaacaaactgaagtctgcaagaaaattcacatttctatctgatgaggatgacttaagtgcccataatcccctttataaggaaaacataagtcaagt

SEQ ID NO: 6153 - DNA, 170 bp, Homo sapiens
tcagtctcagaagacaggaaacatcaacaagttgtgatgcccttttcttccaatactattgaggctcacaagtcagctcatgtagacggatcacttaagagcaacaaactgaagtctgcaagaaaattcacatttctatctgatgaggatgacttaagtgcccataatcc

SEQ ID NO: 6154 - DNA, 170 bp, Homo sapiens
caacaaagcaggggaaataactcagtctcagaagacaggaaacatcaacaagttgtgatgcccttttcttccaatactattgaggctcacaagtcagctcatgtagacggatcacttaagagcaacaaactgaagtctgcaagaaaattcacatttctatctgatgagga

SEQ ID NO: 6155 - DNA, 170 bp, Homo sapiens
tcaagtcttttccttctctaccattttcaacaaagcaggggaaataactcagtctcagaagacaggaaacatcaacaagttgtgatgcccttttcttccaatactattgaggctcacaagtcagctcatgtagacggatcacttaagagcaacaaactgaagtctgcaag

SEQ ID NO: 6156 - DNA, 170 bp, Homo sapiens
gctaacatgtacagtcaaatagaaaaaaactatctacgcacaaatgtttcagaacttcaaactatgtgcccttcagaagtaacaaatatggaaatcacatctgaacaaaacaaggggagtttgaacaatattgtcgagggaactgaaaaacaatctcacagtcaatctac

SEQ ID NO: 6157 - DNA, 170 bp, Homo sapiens
ccttacatttcattatcttcttttctttcaagtcttttccttctctaccattttcaacaaagcaggggaaataactcagtctcagaagacaggaaacatcaacaagttgtgatgcccttttcttccaatactattgaggctcacaagtcagctcatgtagacggatcact

SEQ ID NO: 6158 - DNA, 170 bp, Homo sapiens
agctgtgtcacaacttgtttccttacatttcattatcttcttttctttcaagtcttttccttctctaccattttcaacaaagcaggggaaataactcagtctcagaagacaggaaacatcaacaagttgtgatgcccttttcttccaatactattgaggctcacaagtca

SEQ ID NO: 6159 - DNA, 170 bp, Homo sapiens
tgagagccataaaaacatctttctcatgaaagctgtgtcacaacttgtttccttacatttcattatcttcttttctttcaagtcttttccttctctaccattttcaacaaagcaggggaaataactcagtctcagaagacaggaaacatcaacaagttgtgatgcccttt

SEQ ID NO: 6160 - DNA, 170 bp, Homo sapiens
tgatgtttttaagtatttaatagtaatgagagccataaaaacatctttctcatgaaagctgtgtcacaacttgtttccttacatttcattatcttcttttctttcaagtcttttccttctctaccattttcaacaaagcaggggaaataactcagtctcagaagacagga

SEQ ID NO: 6161 - DNA, 170 bp, Homo sapiens
gtaggttagtgttgtttggcctttgatgtttttaagtatttaatagtaatgagagccataaaaacatctttctcatgaaagctgtgtcacaacttgtttccttacatttcattatcttcttttctttcaagtcttttccttctctaccattttcaacaaagcaggggaaa

SEQ ID NO: 6162 - DNA, 170 bp, Homo sapiens
acttagcagaacttgaaaaatcagtagctaacatgtacagtcaaatagaaaaaaactatctacgcacaaatgtttcagaacttcaaactatgtgcccttcagaagtaacaaatatggaaatcacatctgaacaaaacaaggggagtttgaacaatattgtcgagggaact

SEQ ID NO: 6163 - DNA, 170 bp, Homo sapiens
aggcatcctcagacacgttaaaaacttagcagaacttgaaaaatcagtagctaacatgtacagtcaaatagaaaaaaactatctacgcacaaatgtttcagaacttcaaactatgtgcccttcagaagtaacaaatatggaaatcacatctgaacaaaacaaggggagtt

SEQ ID NO: 6164 - DNA, 170 bp, Homo sapiens
acagaccctcagagagaaccaaaaggcatcctcagacacgttaaaaacttagcagaacttgaaaaatcagtagctaacatgtacagtcaaatagaaaaaaactatctacgcacaaatgtttcagaacttcaaactatgtgcccttcagaagtaacaaatatggaaatcac

SEQ ID NO: 6165 - DNA, 170 bp, Homo sapiens
gcatgaaagctactatgccacagtgaatgaggtcagtttctatttactctctctctgtcctttctgttgatatatgtatctaactatatacaataaatgtttataaatgattcctttaaaattatgagcttaactgtttagaaatatcaagaaaacattaaaaaaatagt

SEQ ID NO: 6166 - DNA, 170 bp, Homo sapiens
ggaatgacaactcacccactttcaagcatgaaagctactatgccacagtgaatgaggtcagtttctatttactctctctctgtcctttctgttgatatatgtatctaactatatacaataaatgtttataaatgattcctttaaaattatgagcttaactgtttagaaat

SEQ ID NO: 6167 - DNA, 170 bp, Homo sapiens
ttctttgagattattataatttaaaaataaacaagaatagaaaaatgtactgaatgaacgagtgctttgacagtgatgagaagctttgtttttaattagtattttaaaagatgcaatttctacattgcagccaccgatgaacatacactccattgtggtgcaggtccagt

SEQ ID NO: 6168 - DNA, 170 bp, Homo sapiens
agtgcgaatagtggtgagagacaggaatgacaactcacccactttcaagcatgaaagctactatgccacagtgaatgaggtcagtttctatttactctctctctgtcctttctgttgatatatgtatctaactatatacaataaatgtttataaatgattcctttaaaat

SEQ ID NO: 6169 - DNA, 170 bp, Homo sapiens
aagtgggcactattatctaccatgaagtgcgaatagtggtgagagacaggaatgacaactcacccactttcaagcatgaaagctactatgccacagtgaatgaggtcagtttctatttactctctctctgtcctttctgttgatatatgtatctaactatatacaataaa

SEQ ID NO: 6170 - DNA, 170 bp, Homo sapiens
ggtgcaggtccagtgcatcaacaaaaaagtgggcactattatctaccatgaagtgcgaatagtggtgagagacaggaatgacaactcacccactttcaagcatgaaagctactatgccacagtgaatgaggtcagtttctatttactctctctctgtcctttctgttgat

SEQ ID NO: 6171 - DNA, 170 bp, Homo sapiens
gccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgaggtcagtttctatt

SEQ ID NO: 6172 - DNA, 170 bp, Homo sapiens
aaaagatgcaatttctacattgcagccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgcca

SEQ ID NO: 6173 - DNA, 170 bp, Homo sapiens
agaagctttgtttttaattagtattttaaaagatgcaatttctacattgcagccaccgatgaacatacactccattgtggtgcaggtccagtgcatcaacaaaaaagtgggcactattatctaccatgaagtgcgaatagtggtgagagacaggaatgacaactcaccca

SEQ ID NO: 6174 - DNA, 170 bp, Homo sapiens
tgaacgagtgctttgacagtgatgagaagctttgtttttaattagtattttaaaagatgcaatttctacattgcagccaccgatgaacatacactccattgtggtgcaggtccagtgcatcaacaaaaaagtgggcactattatctaccatgaagtgcgaatagtggtga

SEQ ID NO: 6175 - DNA, 170 bp, Homo sapiens
aacaagaatagaaaaatgtactgaatgaacgagtgctttgacagtgatgagaagctttgtttttaattagtattttaaaagatgcaatttctacattgcagccaccgatgaacatacactccattgtggtgcaggtccagtgcatcaacaaaaaagtgggcactattatc

SEQ ID NO: 6176 - DNA, 170 bp, Homo sapiens
cagtataatccagatgatccggtatgtaaatacctatttgcaatgtaattttcttaaaaggaataaaattaatgattttttcagctgatagttattgtattattcagtaacttccagaaccagattagtaatgatactattatttaaaaatgtctcaaaattgaattatt

SEQ ID NO: 6177 - DNA, 170 bp, Homo sapiens
tggacagatagagtatgttattcagtataatccagatgatccggtatgtaaatacctatttgcaatgtaattttcttaaaaggaataaaattaatgattttttcagctgatagttattgtattattcagtaacttccagaaccagattagtaatgatactattatttaaa

SEQ ID NO: 6178 - DNA, 170 bp, Homo sapiens
agctacagatatagatgatggaccaaatggacagatagagtatgttattcagtataatccagatgatccggtatgtaaatacctatttgcaatgtaattttcttaaaaggaataaaattaatgattttttcagctgatagttattgtattattcagtaacttccagaacc

SEQ ID NO: 6179 - DNA, 170 bp, Homo sapiens
cacaggattttcaggagacaatggagctacagatatagatgatggaccaaatggacagatagagtatgttattcagtataatccagatgatccggtatgtaaatacctatttgcaatgtaattttcttaaaaggaataaaattaatgattttttcagctgatagttattg

SEQ ID NO: 6180 - DNA, 170 bp, Homo sapiens
actccagttggtaccacaatattcacaggattttcaggagacaatggagctacagatatagatgatggaccaaatggacagatagagtatgttattcagtataatccagatgatccggtatgtaaatacctatttgcaatgtaattttcttaaaaggaataaaattaatg

SEQ ID NO: 6181 - DNA, 170 bp, Homo sapiens
tgatatttaaaatcttttttcctttcagctcactccagttggtaccacaatattcacaggattttcaggagacaatggagctacagatatagatgatggaccaaatggacagatagagtatgttattcagtataatccagatgatccggtatgtaaatacctatttgcaa

SEQ ID NO: 6182 - DNA, 170 bp, Homo sapiens
gtgcagttgataaaatgaaaattgatatttaaaatcttttttcctttcagctcactccagttggtaccacaatattcacaggattttcaggagacaatggagctacagatatagatgatggaccaaatggacagatagagtatgttattcagtataatccagatgatccg

SEQ ID NO: 6183 - DNA, 170 bp, Homo sapiens
gctgatttttatgctgtaacatttctggtgtgcagttgataaaatgaaaattgatatttaaaatcttttttcctttcagctcactccagttggtaccacaatattcacaggattttcaggagacaatggagctacagatatagatgatggaccaaatggacagatagagt

SEQ ID NO: 6184 - DNA, 170 bp, Homo sapiens
tcttcctttaggtaataaagagctgatttttatgctgtaacatttctggtgtgcagttgataaaatgaaaattgatatttaaaatcttttttcctttcagctcactccagttggtaccacaatattcacaggattttcaggagacaatggagctacagatatagatgatg

SEQ ID NO: 6185 - DNA, 170 bp, Homo sapiens
tggttgtgggctgccaactggtatcttcctttaggtaataaagagctgatttttatgctgtaacatttctggtgtgcagttgataaaatgaaaattgatatttaaaatcttttttcctttcagctcactccagttggtaccacaatattcacaggattttcaggagacaa

SEQ ID NO: 6186 - DNA, 170 bp, Homo sapiens
aagactcgctactttgtcataatccaagctaatgtgagtattcaatttcttttaaatttcttctgtgaatttatgaagtaaaaaactcatccaaaatgtatcagatactcttggagagctctgtgccactcacttcttcatcagggcactcctgcccttggtgtttatat

SEQ ID NO: 6187 - DNA, 170 bp, Homo sapiens
ggaagaggctcaactatgaagataagactcgctactttgtcataatccaagctaatgtgagtattcaatttcttttaaatttcttctgtgaatttatgaagtaaaaaactcatccaaaatgtatcagatactcttggagagctctgtgccactcacttcttcatcagggc

SEQ ID NO: 6188 - DNA, 170 bp, Homo sapiens
aatgttgactggaaatatagtgttaaggaagaggctcaactatgaagataagactcgctactttgtcataatccaagctaatgtgagtattcaatttcttttaaatttcttctgtgaatttatgaagtaaaaaactcatccaaaatgtatcagatactcttggagagctc

SEQ ID NO: 6189 - DNA, 170 bp, Homo sapiens
ccaatgacacctttgaaattcccctaatgttgactggaaatatagtgttaaggaagaggctcaactatgaagataagactcgctactttgtcataatccaagctaatgtgagtattcaatttcttttaaatttcttctgtgaatttatgaagtaaaaaactcatccaaaa

SEQ ID NO: 6190 - DNA, 170 bp, Homo sapiens
tctgtatctttaatatttgcagacatccaatgacacctttgaaattcccctaatgttgactggaaatatagtgttaaggaagaggctcaactatgaagataagactcgctactttgtcataatccaagctaatgtgagtattcaatttcttttaaatttcttctgtgaat

SEQ ID NO: 6191 - DNA, 170 bp, Homo sapiens
tcatcttacattcaaataatctgaagtctgtatctttaatatttgcagacatccaatgacacctttgaaattcccctaatgttgactggaaatatagtgttaaggaagaggctcaactatgaagataagactcgctactttgtcataatccaagctaatgtgagtattca

SEQ ID NO: 6192 - DNA, 170 bp, Homo sapiens
aatccaaaatattgagttattaattcatcttacattcaaataatctgaagtctgtatctttaatatttgcagacatccaatgacacctttgaaattcccctaatgttgactggaaatatagtgttaaggaagaggctcaactatgaagataagactcgctactttgtcat

SEQ ID NO: 6193 - DNA, 170 bp, Homo sapiens
tcatctctaacttccaagaggattaatccaaaatattgagttattaattcatcttacattcaaataatctgaagtctgtatctttaatatttgcagacatccaatgacacctttgaaattcccctaatgttgactggaaatatagtgttaaggaagaggctcaactatga

SEQ ID NO: 6194 - DNA, 170 bp, Homo sapiens
agtcattctattttcagatgataagcatgtcatctctaacttccaagaggattaatccaaaatattgagttattaattcatcttacattcaaataatctgaagtctgtatctttaatatttgcagacatccaatgacacctttgaaattcccctaatgttgactggaaat

SEQ ID NO: 6195 - DNA, 170 bp, Homo sapiens
attgactctgaagcttatagtcattctattttcagatgataagcatgtcatctctaacttccaagaggattaatccaaaatattgagttattaattcatcttacattcaaataatctgaagtctgtatctttaatatttgcagacatccaatgacacctttgaaattccc

SEQ ID NO: 6196 - DNA, 170 bp, Homo sapiens
tatcaagctgccatacctgagttgagaactccggtaaatatactcttatctttctccatttatttgcatgttttaaaacccaatgggatcatgttcaagtattttgtagacatataatttataatagcaaaactcagtatatgcacattgaaaaatatttatgtccgaaa

SEQ ID NO: 6197 - DNA, 170 bp, Homo sapiens
ttgccgtccactcacttatcaagctgccatacctgagttgagaactccggtaaatatactcttatctttctccatttatttgcatgttttaaaacccaatgggatcatgttcaagtattttgtagacatataatttataatagcaaaactcagtatatgcacattgaaaa

SEQ ID NO: 6198 - DNA, 170 bp, Homo sapiens
caccttggcctcccaaagttctgggattacaggtatgggccactgctcctggctattgtgcctaatttctataaactacctgttgtttgtttttctccctaacaggaccgtgcccaaaatctgaatgagaggcgaaccaccaccaccactctcacagtggatgttctgga

SEQ ID NO: 6199 - DNA, 170 bp, Homo sapiens
aaacccctgacctcaagtgatccacccaccttggcctcccaaagttctgggattacaggtatgggccactgctcctggctattgtgcctaatttctataaactacctgttgtttgtttttctccctaacaggaccgtgcccaaaatctgaatgagaggcgaaccaccacc

SEQ ID NO: 6200 - DNA, 170 bp, Homo sapiens
gtgtccttgtgccaaacactcgtgattgccgtccactcacttatcaagctgccatacctgagttgagaactccggtaaatatactcttatctttctccatttatttgcatgttttaaaacccaatgggatcatgttcaagtattttgtagacatataatttataatagca

SEQ ID NO: 6201 - DNA, 170 bp, Homo sapiens
agatgacttgggtccaatgtttcttccttgtgtccttgtgccaaacactcgtgattgccgtccactcacttatcaagctgccatacctgagttgagaactccggtaaatatactcttatctttctccatttatttgcatgttttaaaacccaatgggatcatgttcaagt

SEQ ID NO: 6202 - DNA, 170 bp, Homo sapiens
tctcacagtggatgttctggatggagatgacttgggtccaatgtttcttccttgtgtccttgtgccaaacactcgtgattgccgtccactcacttatcaagctgccatacctgagttgagaactccggtaaatatactcttatctttctccatttatttgcatgttttaa

SEQ ID NO: 6203 - DNA, 170 bp, Homo sapiens
gaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggtaaatatactcttatctttct

SEQ ID NO: 6204 - DNA, 170 bp, Homo sapiens
acaggaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaa

SEQ ID NO: 6205 - DNA, 170 bp, Homo sapiens
ctacctgttgtttgtttttctccctaacaggaccgtgcccaaaatctgaatgagaggcgaaccaccaccaccactctcacagtggatgttctggatggagatgacttgggtccaatgtttcttccttgtgtccttgtgccaaacactcgtgattgccgtccactcactta

SEQ ID NO: 6206 - DNA, 170 bp, Homo sapiens
tcctggctattgtgcctaatttctataaactacctgttgtttgtttttctccctaacaggaccgtgcccaaaatctgaatgagaggcgaaccaccaccaccactctcacagtggatgttctggatggagatgacttgggtccaatgtttcttccttgtgtccttgtgcca

SEQ ID NO: 6207 - DNA, 170 bp, Homo sapiens
ggattacaggtatgggccactgctcctggctattgtgcctaatttctataaactacctgttgtttgtttttctccctaacaggaccgtgcccaaaatctgaatgagaggcgaaccaccaccaccactctcacagtggatgttctggatggagatgacttgggtccaatgt

SEQ ID NO: 6208 - DNA, 170 bp, Homo sapiens
ggaatcctctattccatccttgttggtttgtatctgataacattttacactatcagttattctagaatcttacagtaacaaattctctcaattccaaggaaatattttaaataacaaagtttattatttgacatgattgttacttttgtgtataaacacattttaaaaat

SEQ ID NO: 6209 - DNA, 170 bp, Homo sapiens
caaccgccatcagataggccaggaatcctctattccatccttgttggtttgtatctgataacattttacactatcagttattctagaatcttacagtaacaaattctctcaattccaaggaaatattttaaataacaaagtttattatttgacatgattgttacttttgt

SEQ ID NO: 6210 - DNA, 170 bp, Homo sapiens
gccattgatcaggaccggaatattcaaccgccatcagataggccaggaatcctctattccatccttgttggtttgtatctgataacattttacactatcagttattctagaatcttacagtaacaaattctctcaattccaaggaaatattttaaataacaaagtttatt

SEQ ID NO: 6211 - DNA, 170 bp, Homo sapiens
ccccattattgttacgccaccaatccaagccattgatcaggaccggaatattcaaccgccatcagataggccaggaatcctctattccatccttgttggtttgtatctgataacattttacactatcagttattctagaatcttacagtaacaaattctctcaattccaa

SEQ ID NO: 6212 - DNA, 170 bp, Homo sapiens
tttttttttcaggaagaactgaaccccattattgttacgccaccaatccaagccattgatcaggaccggaatattcaaccgccatcagataggccaggaatcctctattccatccttgttggtttgtatctgataacattttacactatcagttattctagaatcttaca

SEQ ID NO: 6213 - DNA, 170 bp, Homo sapiens
tgcggctgaatgaaactctcttaatttttttttcaggaagaactgaaccccattattgttacgccaccaatccaagccattgatcaggaccggaatattcaaccgccatcagataggccaggaatcctctattccatccttgttggtttgtatctgataacattttacac

SEQ ID NO: 6214 - DNA, 170 bp, Homo sapiens
tctcaatccttcatgaagtattagtaatgcggctgaatgaaactctcttaatttttttttcaggaagaactgaaccccattattgttacgccaccaatccaagccattgatcaggaccggaatattcaaccgccatcagataggccaggaatcctctattccatccttgt

SEQ ID NO: 6215 - DNA, 170 bp, Homo sapiens
gttatatagatttccaaactaaagcatctgtctcaatccttcatgaagtattagtaatgcggctgaatgaaactctcttaatttttttttcaggaagaactgaaccccattattgttacgccaccaatccaagccattgatcaggaccggaatattcaaccgccatcaga

SEQ ID NO: 6216 - DNA, 170 bp, Homo sapiens
acttgagtttactgtctcagacgttatatagatttccaaactaaagcatctgtctcaatccttcatgaagtattagtaatgcggctgaatgaaactctcttaatttttttttcaggaagaactgaaccccattattgttacgccaccaatccaagccattgatcaggacc

SEQ ID NO: 6217 - DNA, 170 bp, Homo sapiens
aaaggtattagatcataaatgttgaaacttgagtttactgtctcagacgttatatagatttccaaactaaagcatctgtctcaatccttcatgaagtattagtaatgcggctgaatgaaactctcttaatttttttttcaggaagaactgaaccccattattgttacgcc

SEQ ID NO: 6218 - DNA, 170 bp, Homo sapiens
acagagactttcaccagaaatttgatttggttattaaggtaaattaagctaatatcttatttccttgtgtttatgaactgctaatcagataaatctgtagacgctactgtaggcagttttatgttataaaattaaaattaatgtggacagcagtcagtcaattttttgtt

SEQ ID NO: 6219 - DNA, 170 bp, Homo sapiens
agaacttagtctcctggagccagtaaacagagactttcaccagaaatttgatttggttattaaggtaaattaagctaatatcttatttccttgtgtttatgaactgctaatcagataaatctgtagacgctactgtaggcagttttatgttataaaattaaaattaatgt

SEQ ID NO: 6220 - DNA, 170 bp, Homo sapiens
tttttccatatgcatcctaggacagcagaacttagtctcctggagccagtaaacagagactttcaccagaaatttgatttggttattaaggtaaattaagctaatatcttatttccttgtgtttatgaactgctaatcagataaatctgtagacgctactgtaggcagtt

SEQ ID NO: 6221 - DNA, 170 bp, Homo sapiens
actcctgaggattacccacgatttttccatatgcatcctaggacagcagaacttagtctcctggagccagtaaacagagactttcaccagaaatttgatttggttattaaggtaaattaagctaatatcttatttccttgtgtttatgaactgctaatcagataaatctg

SEQ ID NO: 6222 - DNA, 170 bp, Homo sapiens
gtactgaaatctcaatgtcttccagggactcctgaggattacccacgatttttccatatgcatcctaggacagcagaacttagtctcctggagccagtaaacagagactttcaccagaaatttgatttggttattaaggtaaattaagctaatatcttatttccttgtgt

SEQ ID NO: 6223 - DNA, 170 bp, Homo sapiens
cacatattacttattgttctcaattatgtactgaaatctcaatgtcttccagggactcctgaggattacccacgatttttccatatgcatcctaggacagcagaacttagtctcctggagccagtaaacagagactttcaccagaaatttgatttggttattaaggtaaa

SEQ ID NO: 6224 - DNA, 170 bp, Homo sapiens
tgaagggaaatagaaaaagcagatacacatattacttattgttctcaattatgtactgaaatctcaatgtcttccagggactcctgaggattacccacgatttttccatatgcatcctaggacagcagaacttagtctcctggagccagtaaacagagactttcaccaga

SEQ ID NO: 6225 - DNA, 170 bp, Homo sapiens
ttgtagctttgttcctcagctgatgaagggaaatagaaaaagcagatacacatattacttattgttctcaattatgtactgaaatctcaatgtcttccagggactcctgaggattacccacgatttttccatatgcatcctaggacagcagaacttagtctcctggagcc

SEQ ID NO: 6226 - DNA, 170 bp, Homo sapiens
ttgtgaaacttaatttactaatgaaattgtagctttgttcctcagctgatgaagggaaatagaaaaagcagatacacatattacttattgttctcaattatgtactgaaatctcaatgtcttccagggactcctgaggattacccacgatttttccatatgcatcctagg

SEQ ID NO: 6227 - DNA, 170 bp, Homo sapiens
ccggccgcggagcagtcagccgactacagagaagggtaatcgggtgtccccggcgccgcccggggccctgagggctggctagggtccaggccgggggggacgggacagacgaaccagccccgtgtaggaagcgcgacaatgccccgctacggagcgtcactccgccagag

SEQ ID NO: 6228 - DNA, 170 bp, Homo sapiens
cagccgactacagagaagggtaatcgggtgtccccggcgccgcccggggccctgagggctggctagggtccaggccgggggggacgggacagacgaaccagccccgtgtaggaagcgcgacaatgccccgctacggagcgtcactccgccagagctgccccaggtccggc

SEQ ID NO: 6229 - DNA, 170 bp, Homo sapiens
gcgctggcgctggcgctggcgctggcgctggctctgtctgactctcgggttctctgggctccggcagaggctcaccctctttctccccaaggccatcctgccaggttacatcgcatagtgccccggctccgagatgtctttgggtgggggaacctcacctgcccaatctg

SEQ ID NO: 6230 - DNA, 170 bp, Homo sapiens
ggcgctggctctgtctgactctcgggttctctgggctccggcagaggctcaccctctttctccccaaggccatcctgccaggttacatcgcatagtgccccggctccgagatgtctttgggtgggggaacctcacctgcccaatctgcaaaggtctattcaccgccatca

SEQ ID NO: 6231 - DNA, 170 bp, Homo sapiens
ggttctctgggctccggcagaggctcaccctctttctccccaaggccatcctgccaggttacatcgcatagtgccccggctccgagatgtctttgggtgggggaacctcacctgcccaatctgcaaaggtctattcaccgccatcaacctcgggctgaaggtgagcactg

SEQ ID NO: 6232 - DNA, 170 bp, Homo sapiens
gctcaccctctttctccccaaggccatcctgccaggttacatcgcatagtgccccggctccgagatgtctttgggtgggggaacctcacctgcccaatctgcaaaggtctattcaccgccatcaacctcgggctgaaggtgagcactgaaggggctgcagtggaggaggc

SEQ ID NO: 6233 - DNA, 170 bp, Homo sapiens
ccatcctgccaggttacatcgcatagtgccccggctccgagatgtctttgggtgggggaacctcacctgcccaatctgcaaaggtctattcaccgccatcaacctcgggctgaaggtgagcactgaaggggctgcagtggaggaggccgaaaggagtgctggggctgggg

SEQ ID NO: 6234 - DNA, 170 bp, Homo sapiens
ccccggctccgagatgtctttgggtgggggaacctcacctgcccaatctgcaaaggtctattcaccgccatcaacctcgggctgaaggtgagcactgaaggggctgcagtggaggaggccgaaaggagtgctggggctgggggctggggctgatgctggtgcgctgggct

SEQ ID NO: 6235 - DNA, 170 bp, Homo sapiens
gggaacctcacctgcccaatctgcaaaggtctattcaccgccatcaacctcgggctgaaggtgagcactgaaggggctgcagtggaggaggccgaaaggagtgctggggctgggggctggggctgatgctggtgcgctgggctcagaatgcatccctgatggagagggtg

SEQ ID NO: 6236 - DNA, 170 bp, Homo sapiens
ggtctattcaccgccatcaacctcgggctgaaggtgagcactgaaggggctgcagtggaggaggccgaaaggagtgctggggctgggggctggggctgatgctggtgcgctgggctcagaatgcatccctgatggagagggtggcatctacaatccatcactgagtttgc

SEQ ID NO: 6237 - DNA, 170 bp, Homo sapiens
ggcgccgcccggggccctgagggctggctagggtccaggccgggggggacgggacagacgaaccagccccgtgtaggaagcgcgacaatgccccgctacggagcgtcactccgccagagctgccccaggtccggccgggagcagggacaagacgggaccgccggagcccc

SEQ ID NO: 6238 - DNA, 170 bp, Homo sapiens
gggctggctagggtccaggccgggggggacgggacagacgaaccagccccgtgtaggaagcgcgacaatgccccgctacggagcgtcactccgccagagctgccccaggtccggccgggagcagggacaagacgggaccgccggagcccccggactcctttggatgggcc

SEQ ID NO: 6239 - DNA, 170 bp, Homo sapiens
ggggggacgggacagacgaaccagccccgtgtaggaagcgcgacaatgccccgctacggagcgtcactccgccagagctgccccaggtccggccgggagcagggacaagacgggaccgccggagcccccggactcctttggatgggcctggtgctggcgctggcgctggc

SEQ ID NO: 6240 - DNA, 170 bp, Homo sapiens
ccgtgtaggaagcgcgacaatgccccgctacggagcgtcactccgccagagctgccccaggtccggccgggagcagggacaagacgggaccgccggagcccccggactcctttggatgggcctggtgctggcgctggcgctggcgctggcgctggcgctggctctgtctg

SEQ ID NO: 6241 - DNA, 170 bp, Homo sapiens
ctacggagcgtcactccgccagagctgccccaggtccggccgggagcagggacaagacgggaccgccggagcccccggactcctttggatgggcctggtgctggcgctggcgctggcgctggcgctggcgctggctctgtctgactctcgggttctctgggctccggcag

SEQ ID NO: 6242 - DNA, 170 bp, Homo sapiens
agctgccccaggtccggccgggagcagggacaagacgggaccgccggagcccccggactcctttggatgggcctggtgctggcgctggcgctggcgctggcgctggcgctggctctgtctgactctcgggttctctgggctccggcagaggctcaccctctttctcccca

SEQ ID NO: 6243 - DNA, 170 bp, Homo sapiens
aagacgggaccgccggagcccccggactcctttggatgggcctggtgctggcgctggcgctggcgctggcgctggcgctggctctgtctgactctcgggttctctgggctccggcagaggctcaccctctttctccccaaggccatcctgccaggttacatcgcatagtg

SEQ ID NO: 6244 - DNA, 170 bp, Homo sapiens
ccggactcctttggatgggcctggtgctggcgctggcgctggcgctggcgctggcgctggctctgtctgactctcgggttctctgggctccggcagaggctcaccctctttctccccaaggccatcctgccaggttacatcgcatagtgccccggctccgagatgtcttt

SEQ ID NO: 6245 - DNA, 170 bp, Homo sapiens
tggaaggcaaaggtgtgcactgagcttggtgcactgagtcctgcccagccccagtttggaaatggaggcccaaggggtggtggccaggggttggcctggttcctctgctctgcctctgatttctcaccatgcgctcctcccactgcagaaggaacccaatgtggctcgcg

SEQ ID NO: 6246 - DNA, 170 bp, Homo sapiens
ggtgcactgagtcctgcccagccccagtttggaaatggaggcccaaggggtggtggccaggggttggcctggttcctctgctctgcctctgatttctcaccatgcgctcctcccactgcagaaggaacccaatgtggctcgcgtgggctccgtggccatcaagctgtgca

SEQ ID NO: 6247 - DNA, 170 bp, Homo sapiens
ttgaggatgacatggtggaggtgtggagacgctcagtgctgagcccatctgaggcctgtggcctgctcctgggctccacctgtgggcactgggacattttctcatcttggaacatctctttgcctactgtgccgaagccgccccccaaaccccctagccccccagcccca

SEQ ID NO: 6248 - DNA, 170 bp, Homo sapiens
cgctcagtgctgagcccatctgaggcctgtggcctgctcctgggctccacctgtgggcactgggacattttctcatcttggaacatctctttgcctactgtgccgaagccgccccccaaaccccctagccccccagccccaggtgcccctgtcagccgcatcctcttcct

SEQ ID NO: 6249 - DNA, 170 bp, Homo sapiens
tggcctgctcctgggctccacctgtgggcactgggacattttctcatcttggaacatctctttgcctactgtgccgaagccgccccccaaaccccctagccccccagccccaggtgcccctgtcagccgcatcctcttcctcactgacctgcactgggatcatgactacc

SEQ ID NO: 6250 - DNA, 170 bp, Homo sapiens
acctgtgggcactgggacattttctcatcttggaacatctctttgcctactgtgccgaagccgccccccaaaccccctagccccccagccccaggtgcccctgtcagccgcatcctcttcctcactgacctgcactgggatcatgactacctggagggcacggaccctga

SEQ ID NO: 6251 - DNA, 170 bp, Homo sapiens
tcatcttggaacatctctttgcctactgtgccgaagccgccccccaaaccccctagccccccagccccaggtgcccctgtcagccgcatcctcttcctcactgacctgcactgggatcatgactacctggagggcacggaccctgactgtgcagacccactgtgctgccg

SEQ ID NO: 6252 - DNA, 170 bp, Homo sapiens
actgtgccgaagccgccccccaaaccccctagccccccagccccaggtgcccctgtcagccgcatcctcttcctcactgacctgcactgggatcatgactacctggagggcacggaccctgactgtgcagacccactgtgctgccgccggggttctggcctgccgcccgc

SEQ ID NO: 6253 - DNA, 170 bp, Homo sapiens
cccccagccccaggtgcccctgtcagccgcatcctcttcctcactgacctgcactgggatcatgactacctggagggcacggaccctgactgtgcagacccactgtgctgccgccggggttctggcctgccgcccgcatcccggccaggtgccggatactggggcgaata

SEQ ID NO: 6254 - DNA, 170 bp, Homo sapiens
tgtcagccgcatcctcttcctcactgacctgcactgggatcatgactacctggagggcacggaccctgactgtgcagacccactgtgctgccgccggggttctggcctgccgcccgcatcccggccaggtgccggatactggggcgaatacagcaagtgtgacctgcccc

SEQ ID NO: 6255 - DNA, 170 bp, Homo sapiens
acctgcactgggatcatgactacctggagggcacggaccctgactgtgcagacccactgtgctgccgccggggttctggcctgccgcccgcatcccggccaggtgccggatactggggcgaatacagcaagtgtgacctgcccctgaggaccctggagagcctgttgagt

SEQ ID NO: 6256 - DNA, 170 bp, Homo sapiens
tggagggcacggaccctgactgtgcagacccactgtgctgccgccggggttctggcctgccgcccgcatcccggccaggtgccggatactggggcgaatacagcaagtgtgacctgcccctgaggaccctggagagcctgttgagtgggctgggcccagccggccctttt

SEQ ID NO: 6257 - DNA, 170 bp, Homo sapiens
gtttggaaatggaggcccaaggggtggtggccaggggttggcctggttcctctgctctgcctctgatttctcaccatgcgctcctcccactgcagaaggaacccaatgtggctcgcgtgggctccgtggccatcaagctgtgcaatctgctgaagatagcaccacctgcc

SEQ ID NO: 6258 - DNA, 170 bp, Homo sapiens
cactgtgctgccgccggggttctggcctgccgcccgcatcccggccaggtgccggatactggggcgaatacagcaagtgtgacctgcccctgaggaccctggagagcctgttgagtgggctgggcccagccggcccttttgatatggtgtactggacaggagacatcccc

SEQ ID NO: 6259 - DNA, 170 bp, Homo sapiens
cctgccgcccgcatcccggccaggtgccggatactggggcgaatacagcaagtgtgacctgcccctgaggaccctggagagcctgttgagtgggctgggcccagccggcccttttgatatggtgtactggacaggagacatccccgcacatgatgtctggcaccagactc

SEQ ID NO: 6260 - DNA, 170 bp, Homo sapiens
caggtgccggatactggggcgaatacagcaagtgtgacctgcccctgaggaccctggagagcctgttgagtgggctgggcccagccggcccttttgatatggtgtactggacaggagacatccccgcacatgatgtctggcaccagactcgtcaggaccaactgcgggcc

SEQ ID NO: 6261 - DNA, 170 bp, Homo sapiens
gcaagtgtgacctgcccctgaggaccctggagagcctgttgagtgggctgggcccagccggcccttttgatatggtgtactggacaggagacatccccgcacatgatgtctggcaccagactcgtcaggaccaactgcgggccctgaccaccgtcacagcacttgtgagg

SEQ ID NO: 6262 - DNA, 170 bp, Homo sapiens
gaccctggagagcctgttgagtgggctgggcccagccggcccttttgatatggtgtactggacaggagacatccccgcacatgatgtctggcaccagactcgtcaggaccaactgcgggccctgaccaccgtcacagcacttgtgaggaagttcctggggccagtgccag

SEQ ID NO: 6263 - DNA, 170 bp, Homo sapiens
cccagccggcccttttgatatggtgtactggacaggagacatccccgcacatgatgtctggcaccagactcgtcaggaccaactgcgggccctgaccaccgtcacagcacttgtgaggaagttcctggggccagtgccagtgtaccctgctgtgggtaaccatgaaagca

SEQ ID NO: 6264 - DNA, 170 bp, Homo sapiens
tgtactggacaggagacatccccgcacatgatgtctggcaccagactcgtcaggaccaactgcgggccctgaccaccgtcacagcacttgtgaggaagttcctggggccagtgccagtgtaccctgctgtgggtaaccatgaaagcacacctgtcaatagcttccctccc

SEQ ID NO: 6265 - DNA, 170 bp, Homo sapiens
cacatgatgtctggcaccagactcgtcaggaccaactgcgggccctgaccaccgtcacagcacttgtgaggaagttcctggggccagtgccagtgtaccctgctgtgggtaaccatgaaagcacacctgtcaatagcttccctccccccttcattgagggcaaccactcc

SEQ ID NO: 6266 - DNA, 170 bp, Homo sapiens
ggaccaactgcgggccctgaccaccgtcacagcacttgtgaggaagttcctggggccagtgccagtgtaccctgctgtgggtaaccatgaaagcacacctgtcaatagcttccctccccccttcattgagggcaaccactcctcccgctggctctatgaagcgatggcca

SEQ ID NO: 6267 - DNA, 170 bp, Homo sapiens
caccgtcacagcacttgtgaggaagttcctggggccagtgccagtgtaccctgctgtgggtaaccatgaaagcacacctgtcaatagcttccctccccccttcattgagggcaaccactcctcccgctggctctatgaagcgatggccaaggcttgggagccctggctgc

SEQ ID NO: 6268 - DNA, 170 bp, Homo sapiens
ggccaggggttggcctggttcctctgctctgcctctgatttctcaccatgcgctcctcccactgcagaaggaacccaatgtggctcgcgtgggctccgtggccatcaagctgtgcaatctgctgaagatagcaccacctgccgtgtgccaatccattgtccacctctttg

SEQ ID NO: 6269 - DNA, 170 bp, Homo sapiens
ttcctggggccagtgccagtgtaccctgctgtgggtaaccatgaaagcacacctgtcaatagcttccctccccccttcattgagggcaaccactcctcccgctggctctatgaagcgatggccaaggcttgggagccctggctgcctgccgaagccctgcgcaccctcag

SEQ ID NO: 6270 - DNA, 170 bp, Homo sapiens
gggtaaccatgaaagcacacctgtcaatagcttccctccccccttcattgagggcaaccactcctcccgctggctctatgaagcgatggccaaggcttgggagccctggctgcctgccgaagccctgcgcaccctcaggtacttatcgtccgtggaaacccaggaaggga

SEQ ID NO: 6271 - DNA, 170 bp, Homo sapiens
tgtcaatagcttccctccccccttcattgagggcaaccactcctcccgctggctctatgaagcgatggccaaggcttgggagccctggctgcctgccgaagccctgcgcaccctcaggtacttatcgtccgtggaaacccaggaagggaaaagaaaggtgaatgaaagtg

SEQ ID NO: 6272 - DNA, 170 bp, Homo sapiens
tcattgagggcaaccactcctcccgctggctctatgaagcgatggccaaggcttgggagccctggctgcctgccgaagccctgcgcaccctcaggtacttatcgtccgtggaaacccaggaagggaaaagaaaggtgaatgaaagtgaagggagaagggaacctggggca

SEQ ID NO: 6273 - DNA, 170 bp, Homo sapiens
tggctctatgaagcgatggccaaggcttgggagccctggctgcctgccgaagccctgcgcaccctcaggtacttatcgtccgtggaaacccaggaagggaaaagaaaggtgaatgaaagtgaagggagaagggaacctggggcattgtctctgattgctctagcatgagt

SEQ ID NO: 6274 - DNA, 170 bp, Homo sapiens
tgggagccctggctgcctgccgaagccctgcgcaccctcaggtacttatcgtccgtggaaacccaggaagggaaaagaaaggtgaatgaaagtgaagggagaagggaacctggggcattgtctctgattgctctagcatgagtccttagtgctcttcatttggctcccct

SEQ ID NO: 6275 - DNA, 170 bp, Homo sapiens
ccctgcgcaccctcaggtacttatcgtccgtggaaacccaggaagggaaaagaaaggtgaatgaaagtgaagggagaagggaacctggggcattgtctctgattgctctagcatgagtccttagtgctcttcatttggctcccctaatctgactcctccttccctttcta

SEQ ID NO: 6276 - DNA, 170 bp, Homo sapiens
tcgtccgtggaaacccaggaagggaaaagaaaggtgaatgaaagtgaagggagaagggaacctggggcattgtctctgattgctctagcatgagtccttagtgctcttcatttggctcccctaatctgactcctccttccctttctactgttttgccgcaccaggctttt

SEQ ID NO: 6277 - DNA, 170 bp, Homo sapiens
ctctgctctgcctctgatttctcaccatgcgctcctcccactgcagaaggaacccaatgtggctcgcgtgggctccgtggccatcaagctgtgcaatctgctgaagatagcaccacctgccgtgtgccaatccattgtccacctctttgaggatgacatggtggaggtgt

SEQ ID NO: 6278 - DNA, 170 bp, Homo sapiens
tgcgctcctcccactgcagaaggaacccaatgtggctcgcgtgggctccgtggccatcaagctgtgcaatctgctgaagatagcaccacctgccgtgtgccaatccattgtccacctctttgaggatgacatggtggaggtgtggagacgctcagtgctgagcccatctg

SEQ ID NO: 6279 - DNA, 170 bp, Homo sapiens
gaacccaatgtggctcgcgtgggctccgtggccatcaagctgtgcaatctgctgaagatagcaccacctgccgtgtgccaatccattgtccacctctttgaggatgacatggtggaggtgtggagacgctcagtgctgagcccatctgaggcctgtggcctgctcctggg

SEQ ID NO: 6280 - DNA, 170 bp, Homo sapiens
cgtggccatcaagctgtgcaatctgctgaagatagcaccacctgccgtgtgccaatccattgtccacctctttgaggatgacatggtggaggtgtggagacgctcagtgctgagcccatctgaggcctgtggcctgctcctgggctccacctgtgggcactgggacattt

SEQ ID NO: 6281 - DNA, 170 bp, Homo sapiens
tgaagatagcaccacctgccgtgtgccaatccattgtccacctctttgaggatgacatggtggaggtgtggagacgctcagtgctgagcccatctgaggcctgtggcctgctcctgggctccacctgtgggcactgggacattttctcatcttggaacatctctttgcct

SEQ ID NO: 6282 - DNA, 170 bp, Homo sapiens
gtgtgccaatccattgtccacctctttgaggatgacatggtggaggtgtggagacgctcagtgctgagcccatctgaggcctgtggcctgctcctgggctccacctgtgggcactgggacattttctcatcttggaacatctctttgcctactgtgccgaagccgccccc

SEQ ID NO: 6283 - DNA, 170 bp, Homo sapiens
agttttattttcctggcattcccaacaagtgttccctggggattcagctcatggtcactgttgaaagccttcattcagtccccctttctctagccagggctgcctggacccctggatgccctgattaccatccttaattctccctactaggtgcatataattggccacat

SEQ ID NO: 6284 - DNA, 170 bp, Homo sapiens
caagtgttccctggggattcagctcatggtcactgttgaaagccttcattcagtccccctttctctagccagggctgcctggacccctggatgccctgattaccatccttaattctccctactaggtgcatataattggccacattcccccagggcactgtctgaagagc

SEQ ID NO: 6285 - DNA, 170 bp, Homo sapiens
tggtcactgttgaaagccttcattcagtccccctttctctagccagggctgcctggacccctggatgccctgattaccatccttaattctccctactaggtgcatataattggccacattcccccagggcactgtctgaagagctggagctggaattattaccgaattgt

SEQ ID NO: 6286 - DNA, 170 bp, Homo sapiens
cagtccccctttctctagccagggctgcctggacccctggatgccctgattaccatccttaattctccctactaggtgcatataattggccacattcccccagggcactgtctgaagagctggagctggaattattaccgaattgtagccaggtaggacggagatgaggg

SEQ ID NO: 6287 - DNA, 170 bp, Homo sapiens
cctggacccctggatgccctgattaccatccttaattctccctactaggtgcatataattggccacattcccccagggcactgtctgaagagctggagctggaattattaccgaattgtagccaggtaggacggagatgagggtgggaatagggacagggtgagtgtctg

SEQ ID NO: 6288 - DNA, 170 bp, Homo sapiens
taccatccttaattctccctactaggtgcatataattggccacattcccccagggcactgtctgaagagctggagctggaattattaccgaattgtagccaggtaggacggagatgagggtgggaatagggacagggtgagtgtctgaaggctgaaaattcccttgagca

SEQ ID NO: 6289 - DNA, 170 bp, Homo sapiens
ggtgcatataattggccacattcccccagggcactgtctgaagagctggagctggaattattaccgaattgtagccaggtaggacggagatgagggtgggaatagggacagggtgagtgtctgaaggctgaaaattcccttgagcatctcaccatccctgttgtcccatg

SEQ ID NO: 6290 - DNA, 170 bp, Homo sapiens
gggcactgtctgaagagctggagctggaattattaccgaattgtagccaggtaggacggagatgagggtgggaatagggacagggtgagtgtctgaaggctgaaaattcccttgagcatctcaccatccctgttgtcccatggagtggggaggctcctcactagaacagg

SEQ ID NO: 6291 - DNA, 170 bp, Homo sapiens
gagctggaattattaccgaattgtagccaggtaggacggagatgagggtgggaatagggacagggtgagtgtctgaaggctgaaaattcccttgagcatctcaccatccctgttgtcccatggagtggggaggctcctcactagaacaggttggagaaagagggcatcct

SEQ ID NO: 6292 - DNA, 170 bp, Homo sapiens
aaattcccttgagcatctcaccatccctgttgtcccatggagtggggaggctcctcactagaacaggttggagaaagagggcatcctatctccccagatgtcttcctacccctccctagaatcttctgaatgtagtaccttctggccaggtatgagaacaccctggctgc

SEQ ID NO: 6293 - DNA, 170 bp, Homo sapiens
ccctgttgtcccatggagtggggaggctcctcactagaacaggttggagaaagagggcatcctatctccccagatgtcttcctacccctccctagaatcttctgaatgtagtaccttctggccaggtatgagaacaccctggctgctcagttctttggccacactcatgt

SEQ ID NO: 6294 - DNA, 170 bp, Homo sapiens
tgtagccttcctggcacccagtgcaactacctacatcggccttaatcctggtgagtgaggcagaagggagcctcccttatcctggagttggtgggataggggaaggaggttggagccagagcctgcaaagcatgggcaggatgtgtggcccctccctggagttacccttg

SEQ ID NO: 6295 - DNA, 170 bp, Homo sapiens
tcctcactagaacaggttggagaaagagggcatcctatctccccagatgtcttcctacccctccctagaatcttctgaatgtagtaccttctggccaggtatgagaacaccctggctgctcagttctttggccacactcatgtggatgaatttgaggtcttctatgatga

SEQ ID NO: 6296 - DNA, 170 bp, Homo sapiens
agaaagagggcatcctatctccccagatgtcttcctacccctccctagaatcttctgaatgtagtaccttctggccaggtatgagaacaccctggctgctcagttctttggccacactcatgtggatgaatttgaggtcttctatgatgaagagactctgagccggccgc

SEQ ID NO: 6297 - DNA, 170 bp, Homo sapiens
tgtcttcctacccctccctagaatcttctgaatgtagtaccttctggccaggtatgagaacaccctggctgctcagttctttggccacactcatgtggatgaatttgaggtcttctatgatgaagagactctgagccggccgctggctgtagccttcctggcacccagtg

SEQ ID NO: 6298 - DNA, 170 bp, Homo sapiens
tctgaatgtagtaccttctggccaggtatgagaacaccctggctgctcagttctttggccacactcatgtggatgaatttgaggtcttctatgatgaagagactctgagccggccgctggctgtagccttcctggcacccagtgcaactacctacatcggccttaatcct

SEQ ID NO: 6299 - DNA, 170 bp, Homo sapiens
ggtatgagaacaccctggctgctcagttctttggccacactcatgtggatgaatttgaggtcttctatgatgaagagactctgagccggccgctggctgtagccttcctggcacccagtgcaactacctacatcggccttaatcctggtgagtgaggcagaagggagcct

SEQ ID NO: 6300 - DNA, 170 bp, Homo sapiens
cagttctttggccacactcatgtggatgaatttgaggtcttctatgatgaagagactctgagccggccgctggctgtagccttcctggcacccagtgcaactacctacatcggccttaatcctggtgagtgaggcagaagggagcctcccttatcctggagttggtggga

SEQ ID NO: 6301 - DNA, 170 bp, Homo sapiens
tgaatttgaggtcttctatgatgaagagactctgagccggccgctggctgtagccttcctggcacccagtgcaactacctacatcggccttaatcctggtgagtgaggcagaagggagcctcccttatcctggagttggtgggataggggaaggaggttggagccagagc

SEQ ID NO: 6302 - DNA, 170 bp, Homo sapiens
ctctgagccggccgctggctgtagccttcctggcacccagtgcaactacctacatcggccttaatcctggtgagtgaggcagaagggagcctcccttatcctggagttggtgggataggggaaggaggttggagccagagcctgcaaagcatgggcaggatgtgtggccc

SEQ ID NO: 6303 - DNA, 170 bp, Homo sapiens
ggagcctcccttatcctggagttggtgggataggggaaggaggttggagccagagcctgcaaagcatgggcaggatgtgtggcccctccctggagttacccttgctccttgcccctccagtcagccccacatccttgcaggttaccgtgtgtaccaaatagatggaaact

SEQ ID NO: 6304 - DNA, 170 bp, Homo sapiens
ggtgggataggggaaggaggttggagccagagcctgcaaagcatgggcaggatgtgtggcccctccctggagttacccttgctccttgcccctccagtcagccccacatccttgcaggttaccgtgtgtaccaaatagatggaaactactccgggagctctcacgtggtc

SEQ ID NO: 6305 - DNA, 170 bp, Homo sapiens
cataccgcactggcagcttctctacagggctcgagaaacctatgggctgcccaacacactgcctaccgcctggcacaacctggtatatcgcatgcggggcgacatgcaacttttccagaccttctggtttctctaccataagggccacccaccctcggagccctgtggca

SEQ ID NO: 6306 - DNA, 170 bp, Homo sapiens
gctcgagaaacctatgggctgcccaacacactgcctaccgcctggcacaacctggtatatcgcatgcggggcgacatgcaacttttccagaccttctggtttctctaccataagggccacccaccctcggagccctgtggcacgccctgccgtctggctactctttgtgc

SEQ ID NO: 6307 - DNA, 170 bp, Homo sapiens
acacactgcctaccgcctggcacaacctggtatatcgcatgcggggcgacatgcaacttttccagaccttctggtttctctaccataagggccacccaccctcggagccctgtggcacgccctgccgtctggctactctttgtgcccagctctctgcccgtgctgacagc

SEQ ID NO: 6308 - DNA, 170 bp, Homo sapiens
acctggtatatcgcatgcggggcgacatgcaacttttccagaccttctggtttctctaccataagggccacccaccctcggagccctgtggcacgccctgccgtctggctactctttgtgcccagctctctgcccgtgctgacagccctgctctgtgccgccacctgatg

SEQ ID NO: 6309 - DNA, 170 bp, Homo sapiens
acatgcaacttttccagaccttctggtttctctaccataagggccacccaccctcggagccctgtggcacgccctgccgtctggctactctttgtgcccagctctctgcccgtgctgacagccctgctctgtgccgccacctgatgccagatgggagcctcccagaggcc

SEQ ID NO: 6310 - DNA, 170 bp, Homo sapiens
gtttctctaccataagggccacccaccctcggagccctgtggcacgccctgccgtctggctactctttgtgcccagctctctgcccgtgctgacagccctgctctgtgccgccacctgatgccagatgggagcctcccagaggcccagagcctgtggccaaggccactgt

SEQ ID NO: 6311 - DNA, 170 bp, Homo sapiens
gagccctgtggcacgccctgccgtctggctactctttgtgcccagctctctgcccgtgctgacagccctgctctgtgccgccacctgatgccagatgggagcctcccagaggcccagagcctgtggccaaggccactgttttgctagggccccagggcccacatttggga

SEQ ID NO: 6312 - DNA, 170 bp, Homo sapiens
cgtctggctactctttgtgcccagctctctgcccgtgctgacagccctgctctgtgccgccacctgatgccagatgggagcctcccagaggcccagagcctgtggccaaggccactgttttgctagggccccagggcccacatttgggaaagttcttgatgtaggaaagg

SEQ ID NO: 6313 - DNA, 170 bp, Homo sapiens
tctgcccgtgctgacagccctgctctgtgccgccacctgatgccagatgggagcctcccagaggcccagagcctgtggccaaggccactgttttgctagggccccagggcccacatttgggaaagttcttgatgtaggaaagggtgaaaaagcccaaatgctgctgtggt

SEQ ID NO: 6314 - DNA, 170 bp, Homo sapiens
ctgctctgtgccgccacctgatgccagatgggagcctcccagaggcccagagcctgtggccaaggccactgttttgctagggccccagggcccacatttgggaaagttcttgatgtaggaaagggtgaaaaagcccaaatgctgctgtggttcaaccaggcaagatcatc

SEQ ID NO: 6315 - DNA, 170 bp, Homo sapiens
gagcctgcaaagcatgggcaggatgtgtggcccctccctggagttacccttgctccttgcccctccagtcagccccacatccttgcaggttaccgtgtgtaccaaatagatggaaactactccgggagctctcacgtggtcctggaccatgagacctacatcctgaatct

SEQ ID NO: 6316 - DNA, 170 bp, Homo sapiens
atgggagcctcccagaggcccagagcctgtggccaaggccactgttttgctagggccccagggcccacatttgggaaagttcttgatgtaggaaagggtgaaaaagcccaaatgctgctgtggttcaaccaggcaagatcatccggtgaaagaaccagtccctgggcccc

SEQ ID NO: 6317 - DNA, 170 bp, Homo sapiens
tgtggccaaggccactgttttgctagggccccagggcccacatttgggaaagttcttgatgtaggaaagggtgaaaaagcccaaatgctgctgtggttcaaccaggcaagatcatccggtgaaagaaccagtccctgggccccaaggatgccggggaaacaggaccttct

SEQ ID NO: 6318 - DNA, 170 bp, Homo sapiens
ggatgtgtggcccctccctggagttacccttgctccttgcccctccagtcagccccacatccttgcaggttaccgtgtgtaccaaatagatggaaactactccgggagctctcacgtggtcctggaccatgagacctacatcctgaatctgacccaggcaaacataccgg

SEQ ID NO: 6319 - DNA, 170 bp, Homo sapiens
tccttgcccctccagtcagccccacatccttgcaggttaccgtgtgtaccaaatagatggaaactactccgggagctctcacgtggtcctggaccatgagacctacatcctgaatctgacccaggcaaacataccgggagccataccgcactggcagcttctctacaggg

SEQ ID NO: 6320 - DNA, 170 bp, Homo sapiens
ccccacatccttgcaggttaccgtgtgtaccaaatagatggaaactactccgggagctctcacgtggtcctggaccatgagacctacatcctgaatctgacccaggcaaacataccgggagccataccgcactggcagcttctctacagggctcgagaaacctatgggct

SEQ ID NO: 6321 - DNA, 170 bp, Homo sapiens
cgtgtgtaccaaatagatggaaactactccgggagctctcacgtggtcctggaccatgagacctacatcctgaatctgacccaggcaaacataccgggagccataccgcactggcagcttctctacagggctcgagaaacctatgggctgcccaacacactgcctaccgc

SEQ ID NO: 6322 - DNA, 170 bp, Homo sapiens
ggagctctcacgtggtcctggaccatgagacctacatcctgaatctgacccaggcaaacataccgggagccataccgcactggcagcttctctacagggctcgagaaacctatgggctgcccaacacactgcctaccgcctggcacaacctggtatatcgcatgcggggc

SEQ ID NO: 6323 - DNA, 170 bp, Homo sapiens
ccatgagacctacatcctgaatctgacccaggcaaacataccgggagccataccgcactggcagcttctctacagggctcgagaaacctatgggctgcccaacacactgcctaccgcctggcacaacctggtatatcgcatgcggggcgacatgcaacttttccagacct

SEQ ID NO: 6324 - DNA, 170 bp, Homo sapiens
ccaggcaaacataccgggagccataccgcactggcagcttctctacagggctcgagaaacctatgggctgcccaacacactgcctaccgcctggcacaacctggtatatcgcatgcggggcgacatgcaacttttccagaccttctggtttctctaccataagggccacc

SEQ ID NO: 6325 - DNA, 22 bp, Homo sapiens
gagaatgatgatgaagtacagg

SEQ ID NO: 6326 - DNA, 10 bp, Homo sapiens
agttgttaca

SEQ ID NO: 6327 - DNA, 11 bp, Homo sapiens
aatttggtgct

SEQ ID NO: 6328 - DNA, 12 bp, Homo sapiens
agggatagaagg

SEQ ID NO: 6329 - DNA, 12 bp, Homo sapiens
agggataggagg

SEQ ID NO: 6330 - DNA, 29 bp, Homo sapiens
accttctgtccaggggcgatgagggcatt

SEQ ID NO: 6331 - protein, 9 aa, Homo sapiens
KQGPAILAN

SEQ ID NO: 6332 - DNA, 124 bp, Homo sapiens
  CDS (67)..(123)
ataaagtcgttcacagaagagagaaataacatgaggttcatttacgtcttttgtgcatctataggagaaggagaaggaagagttggtattatcctgactttagccatgaatatcatgagtacat

SEQ ID NO: 6333 - protein, 19 aa, Homo sapiens
EGEGRVGIILTLAMNIMST

SEQ ID NO: 6334 - DNA, 123 bp, Homo sapiens
  misc_feature (59)..(123): This region codes for the protein disclosed as SEQ ID NO: 6335
ctaattgtgaaattgtctgccattcttaaaaacaaaaatgttgttatttttatttcagatgcgatctgtgagccgagtctttaagttcattgacatgccaacagaaggtaaacctaccaagtc

SEQ ID NO: 6335 - protein, 22 aa, Homo sapiens
  misc_feature (1)..(22): This protein is encoded by positions 59 to 123 of the nucleotide sequence disclosed as SEQ ID NO: 6334
MRSVSRVFKFIDMPTEGKPTKS

SEQ ID NO: 6336 - DNA, 15 bp, Homo sapiens
catctattggagaag

SEQ ID NO: 6337 - DNA, 15 bp, Homo sapiens
tcagatgtgatctgt

SEQ ID NO: 6338 - DNA, 50 bp, Artificial Sequence
  Description of Artificial Sequence: Synthetic oligonucleotide
agatctatacggctaggatcgttcattggccacgcatacgatggcattgc

SEQ ID NO: 6339 - DNA, 50 bp, Artificial Sequence
  Description of Artificial Sequence: Synthetic oligonucleotide
ggggatcgtcataagatctatacggctaggatcgtttacgatggcattgc

SEQ ID NO: 6340 - DNA, 50 bp, Artificial Sequence
  Description of Artificial Sequence: Synthetic oligonucleotide
cgctaggatcgttcattggccacgcattttacgctgtacgatggcattgc

SEQ ID NO: 6341 - DNA, 50 bp, Artificial Sequence
  Description of Artificial Sequence: Synthetic oligonucleotide
gcaggcgtatcccgatctatctatcccattaccccctacgatggcattgc

SEQ ID NO: 6342 - DNA, 50 bp, Artificial Sequence
  Description of Artificial Sequence: Synthetic oligonucleotide
cgatctatctatcccattacccccccagatccatcctacgatggcattgc

SEQ ID NO: 6343 - DNA, 50 bp, Artificial Sequence
  Description of Artificial Sequence: Synthetic oligonucleotide
cccccccagatccatcccatccatcgagtctctccgtacgatggcattgc

SEQ ID NO: 6344 - DNA, 50 bp, Artificial Sequence
  Description of Artificial Sequence: Synthetic oligonucleotide
agatctatacggctaggatcgttcattggccacgcacatccgatccatgg

SEQ ID NO: 6345 - DNA, 50 bp, Artificial Sequence
  Description of Artificial Sequence: Synthetic oligonucleotide
ggggatcgtcataagatctatacggctaggatcgttcatccgatccatgg

SEQ ID NO: 6346 - DNA, 50 bp, Artificial Sequence
  Description of Artificial Sequence: Synthetic oligonucleotide
cgctaggatcgttcattggccacgcattttacgctgcatccgatccatgg

SEQ ID NO: 6347 - DNA, 50 bp, Artificial Sequence
  Description of Artificial Sequence: Synthetic oligonucleotide
gcaggcgtatcccgatctatctatcccattaccccccatccgatccatgg

SEQ ID NO: 6348 - DNA, 50 bp, Artificial Sequence
  Description of Artificial Sequence: Synthetic oligonucleotide
cgatctatctatcccattacccccccagatccatcccatccgatccatgg

SEQ ID NO: 6349 - DNA, 50 bp, Artificial Sequence
  Description of Artificial Sequence: Synthetic oligonucleotide
cccccccagatccatcccatccatcgagtctctccgcatccgatccatgg

SEQ ID NO: 6350 - DNA, 36 bp, Homo sapiens
cgctaggatcgttcattggccacgcattttacgctg

SEQ ID NO: 6351 - DNA, 58 bp, Homo sapiens
ggggatcgtcataagatctataccgtaggatcgttcattggccacgcattttacgctg

SEQ ID NO: 6352 - DNA, 36 bp, Homo sapiens
agatctatacggctaggatcgttcattggccacgca

SEQ ID NO: 6353 - DNA, 36 bp, Homo sapiens
cgatctatctatcccattacccgcccagatccatcc

SEQ ID NO: 6354 - DNA, 67 bp, Homo sapiens
gcaggcgtatcccgatctatctatcccattacccgcccagatccatcccatccatcgagtctctccg

SEQ ID NO: 6355 - DNA, 36 bp, Homo sapiens
cccccccagatccatcccatccatcgagtctctccg

SEQ ID NO: 6356 - DNA, 36 bp, Homo sapiens
gcaggcgtatcccgatctatctatcccattacccgc

SEQ ID NO: 6357 - DNA, 14 bp, Artificial Sequence
  Description of Artificial Sequence: Synthetic oligonucleotide
tacgatggcattgc

SEQ ID NO: 6358 - DNA, 36 bp, Homo sapiens
ggggatcgtcataagatctatacggctaggatcgtt

SEQ ID NO: 6359 - DNA, 59 bp, Homo sapiens
ggggatcgtcataagatctatacggctaggatcgttcattggccacgcattttacgctg

SEQ ID NO: 6360 - DNA, 36 bp, Homo sapiens
gcaggcgtatcccgatctatctatcccattaccccc

SEQ ID NO: 6361 - DNA, 36 bp, Homo sapiens
cgatctatctatcccattacccccccagatccatcc

SEQ ID NO: 6362 - DNA, 69 bp, Homo sapiens
gcaggcgtatcccgatctatctatcccattacccccccagatccatcccatccatcgagtctctccgat

SEQ ID NO: 6363 - DNA, 69 bp, Homo sapiens
gcaggcgtatcccgatctatctatcccattacccgcccagatccatcccatccatcgagtctctccgat

SEQ ID NO: 6364 - DNA, 14 bp, Artificial Sequence
  Description of Artificial Sequence: Synthetic oligonucleotide
catccgatccatgg

SEQ ID NO: 6365 - DNA, 18 bp, Homo sapiens
  CDS (3)..(17)
ctacatatctgacaggtg

SEQ ID NO: 6366 - protein, 5 aa, Homo sapiens
TYLTG

SEQ ID NO: 6367 - DNA, 58 bp, Homo sapiens
  CDS (3)..(56)
ggatgggcctggtgctggcgctggcgctggcgctggcgctggcgctggctctgtctga

SEQ ID NO: 6368 - protein, 18 aa, Homo sapiens
MGLVLALALALALALALS

SEQ ID NO: 6369 - DNA, 21 bp, Homo sapiens
  CDS (3)..(20)
ggatgggcctggtgctggcgc

SEQ ID NO: 6370 - protein, 6 aa, Homo sapiens
MGLVLA

SEQ ID NO: 6371 - DNA, 21 bp, Homo sapiens
tatgtattaccgaaaaagcct

SEQ ID NO: 6372 - DNA, 21 bp, Homo sapiens
tatgtattactgaaaaagcct

SEQ ID NO: 6373 - DNA, 99 bp, Homo sapiens
  CDS (4)..(99)
aggtttagcatgagctttaacagacataatctgaaatactatgtattaccgaaaaagcctaaaaaggtggcatttgattgcctagaatggatcagaaag

SEQ ID NO: 6374 - protein, 32 aa, Homo sapiens
FSMSFNRHNLKYYVLPKKPKKVAFDCLEWIRK

SEQ ID NO: 6375 - DNA, 93 bp, Homo sapiens
  misc_feature (1)..(93): This sequence may encompass 29-31 'cgg' repeating units
cggcggcggcggcggcggcggcggcggcggcggcggcggcggcggcggcggcggcggcggcggcggcggcggcggcggcggcggcggcggcgg

SEQ ID NO: 6376 - DNA, 600 bp, Homo sapiens
  misc_feature (1)..(600): This sequence may encompass 55-200 'cgg' repeating units
cggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcgg

SEQ ID NO: 6377 - DNA, 600 bp, Homo sapiens; identical to SEQ ID NO: 6376

SEQ ID NO: 6378 - DNA, 180 bp, Homo sapiens
  misc_feature (1)..(180): This sequence may encompass 40-60 'cgg' repeating units
cggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcggcgg

What is claimed is:

1. A method for capturing and sequencing a nucleic acid target, the method comprising:
   providing a sample comprising human nucleic acid;
   introducing a probe set comprising a plurality of different molecular inversion probes, wherein each probe is designed to capture one of a plurality of overlapping sub-regions of a target on a strand of the nucleic acid;
   hybridizing the probes to the strand;
   converting the hybridized probes into covalently-closed circularized probes, thereby capturing the overlapping sub-regions of the target, wherein at least two different molecular inversion probes capture any given single base along the target;
   isolating the circularized probes;
   amplifying the isolated circularized probes to generate amplicons;
   sequencing the amplicons to generate sequence reads of the captured sub-regions; and
   analyzing the sequence reads to detect a mutation in said target nucleic acid specific for a disease.

2. The method of claim 1, wherein the amplification step requires a single set of primers.

3. The method of claim 1, wherein the disease is selected from the group consisting of: Familial hyperinsulinism, Canavan disease, Maple Syrup Urine disease, Bloom syndrome, Cystic fibrosis, Dihydrolipoamide dehydrogenase deficiency, Fanconi anemia, Glycogen Storage disease, Tay-Sachs diseases, Familial dysautonomia, Mucolipidosis, Usher syndrome, and Neimann-Pick disease.

4. The method of claim 1, wherein the plurality of sub-regions comprises coding and non-coding regions of the human nucleic acid.

5. The method of claim 1, wherein the probe set is a plurality of probe sets, each probe set specific for a different target nucleic acid and wherein each target nucleic acid is specific for a different disease.

6. The method of claim 1, wherein said analyzing step comprises:
   assembling the sequence reads into contigs; aligning the contigs to a reference; and
   aligning the sequence reads to the contigs to determine mapping and variant information of the sequence reads relative to said reference to obtain a genotype at said mutation.

7. The method of claim 1, wherein the overlapping sub-regions are at least 10 base-pairs in length.

8. The method of claim 1, wherein the plurality of overlapping sub-regions of the target nucleic acid are from a gene selected from the list consisting of: ATP-binding cassette, sub-family C (CFTR/MRP), member 8 (ABCC8); aspartoacylase (ASPA); branched chain keto acid dehydrogenase E1, alpha polypeptide (BCKDHA); branched chain keto acid dehydrogenase E1, beta polypeptide (BCKDHB); Bloom Syndrome, RecQ Helicase-Like (BLM); cystic fibrosis transmembrane conductance regulator (CFTR), clarin 1 (CLRN1); dihydrolipoamide dehydrogenase (DLD); Fanconi anemia, complementation group C (FANCC); glucose-6-phosphatase, catalytic subunit (G6PC); hexosaminidase A alpha polypeptide (HEXA); kinase complex-associated protein (IKBKAP); mucolipin 1 (MCOLN1); protocadherin-related 15 (PCDH15); and sphingomyelin phosphodiesterase 1, acid lysosomal (SMPD1).

9. The method of claim 1, wherein each probe is a molecular inversion probe (MIP) that comprises an oligonucleotide with
a first targeting arm at a 5' end and
a second targeting arm at a 3' end, wherein the first and second targeting arms are capable of specifically hybridizing to a first and second regions flanking one of the overlapping subregions.

10. The method of claim 9, wherein each MIP includes a differentiator tag between the first and second targeting arms, wherein the differentiator tags are different across the probe set.

11. The method of claim 10, wherein each differentiator tag provides a unique sequence tag to an individual target molecule captured by one of the plurality of different molecular inversion probes.

12. The method of claim 11, wherein, after the amplifying and sequencing steps, the differentiator tags distinguish independent target molecules from one another.

13. The method of claim 11, wherein the enzymatic removal uses an exonuclease.

14. The method of claim 9, wherein the isolating step comprises enzymatic removal of non-circularized nucleic acid.

* * * * *